United States Patent 12,508,308 (INFLUENZA mRNA VACCINES) - sequence listing, part 55

SEQ ID NO: 214603 - RNA, 1942 nt, Artificial Sequence
  mRNA product opt Design1 from Influenza A H1N1 hemagglutinin
gggagaaagcuuaccauggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214604 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccgugauggccccgcggacccugguccuccugcugagcggcgcgcucgcccugacccagacgugggccggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214605 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214606 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugacccgccugaccgugcucgcccugcuggccggccuccuggcgagcucccgggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214607 - RNA, 2080 nt, Artificial Sequence
  mRNA product opt Design2 from Influenza A H1N1 hemagglutinin
ggggcgcugccuacggagguggcagccaucuccuucucggcaucaagcuuaccaugccccugcuccugcugcucccgcugcugugggccggcgcccucgcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214608 - RNA, 2089 nt, Artificial Sequence
  mRNA product opt Design2 from Influenza A H1N1 hemagglutinin
ggggcgcugccuacggagguggcagccaucuccuucucggcaucaagcuuaccaugaucaagcugaaguucggcguguucuucaccguccuccugagcuccgccuacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214609 - RNA, 2086 nt, Artificial Sequence
  mRNA product opt Design2 from Influenza A H1N1 hemagglutinin
ggggcgcugccuacggagguggcagccaucuccuucucggcaucaagcuuaccauggccuuccuguggcuccugagcugcugggcccugcucggcaccaccuucggggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214610 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggagugaaaguucuuuuugcccuuauuuguauugcuguggccgaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214611 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugggcgugaagguccuguucgcccucaucugcaucgccguggcggaggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214612 - RNA, 2083 nt, Artificial Sequence; identical to SEQ ID NO: 213611
  mRNA product opt Design2 from Influenza A H1N1 hemagglutinin

SEQ ID NO: 214613 - RNA, 2104 nt, Artificial Sequence
  mRNA product opt Design2 from Influenza A H1N1 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214614 - RNA, 2092 nt, Artificial Sequence
  mRNA product opt Design2 from Influenza A H1N1 hemagglutinin
ggggcgcugccuacggagguggcagccaucuccuucucggcaucaagcuuaccauguaccggaugcagcugcucagcugcaucgcccugucgcuggcgcucgugaccaacagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214615 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugcgcgccuggaucuucuuccugcucugccuggccggccgggcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214616 - RNA, 2101 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccuccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214617 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214618 - RNA, 2098 nt, Artificial Sequence
  mRNA product opt Design2 from Influenza A H1N1 hemagglutinin
ggggcgcugccuacggagguggcagccaucuccuucucggcaucaagcuuaccauggacgccaugaagcgcggccugugcugcgugcuccugcugugcggggccgucuucgugagccccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214619 - RNA, 2113 nt, Artificial Sequence
  mRNA product opt Design2 from Influenza A H1N1 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214620 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggaguucggccugagcuggguguuccucgucgcccuguuccgcggggugcagugcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214621 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggacuggaccuggcgcguguucugccugcucgccgucacccccggcgcccacccggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214622 - RNA, 2089 nt, Artificial Sequence
  mRNA product opt Design2 from Influenza A H1N1 hemagglutinin
ggggcgcugccuacggagguggcagccaucuccuucucggcaucaagcuuaccauggccuggagcccccuguuccucacccugaucacccacugcgccggcuccugggcggacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214623 - RNA, 2095 nt, Artificial Sequence
  mRNA product opt Design2 from Influenza A H1N1 hemagglutinin
ggggcgcugccuacggagguggcagccaucuccuucucggcaucaagcuuaccauggagaccgacacccugcuccugugggugcugcuccuguggguccccggcagcacgggggacgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214624 - RNA, 2110 nt, Artificial Sequence
  mRNA product opt Design2 from Influenza A H1N1 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214625 - RNA, 2095 nt, Artificial Sequence
  mRNA product opt Design2 from Influenza A H1N1 hemagglutinin
ggggcgcugccuacggagguggcagccaucuccuucucggcaucaagcuuaccaugggcaugcgcaugauguucaucauguucaugcuggugguccucgccaccaccguggugagcgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214626 - RNA, 2092 nt, Artificial Sequence
  mRNA product opt Design2 from Influenza A H1N1 hemagglutinin
ggggcgcugccuacggagguggcagccaucuccuucucggcaucaagcuuaccauggcccgcccccugugcacccuccugcugcucauggccacccuggcgggcgcccuggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214627 - RNA, 2107 nt, Artificial Sequence
  mRNA product opt Design2 from Influenza A H1N1 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214628 - protein, 568 aa, Artificial Sequence
  derived and/or modified sequence from Influenza A H3N2 hemagglutinin
MKWVTFISLLFLFSSAYSQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214629 - protein, 568 aa, Artificial Sequence
  derived and/or modified sequence from Influenza A H3N2 hemagglutinin
MDWTWILFLVAAATRVHSQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214630 - protein, 574 aa, Artificial Sequence
  derived and/or modified sequence from Influenza A H3N2 hemagglutinin
MPMGSLQPLATLYLLGMLVASCLGQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214631 - protein, 574 aa, Artificial Sequence
  derived and/or modified sequence from Influenza A H3N2 hemagglutinin
MAVMAPRTLVLLLSGALALTQTWAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214632 - protein, 575 aa, Artificial Sequence
  derived and/or modified sequence from Influenza A H3N2 hemagglutinin
MAVMAPRTLVLLLSGALALTQTWAGQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214633 - protein, 574 aa, Artificial Sequence
  derived and/or modified sequence from Influenza A H3N2 hemagglutinin
MASSLYSFLLALSIVYIFVAPTHSQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214634 - protein, 569 aa, Artificial Sequence
  derived and/or modified sequence from Influenza A H3N2 hemagglutinin
MTRLTVLALLAGLLASSRAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214635 - protein, 566 aa, Artificial Sequence
  derived and/or modified sequence from Influenza A H3N2 hemagglutinin
MPLLLLLPLLWAGALAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214636 - protein, 569 aa, Artificial Sequence
  derived and/or modified sequence from Influenza A H3N2 hemagglutinin
MIKLKFGVFFTVLLSSAYAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214637 - protein, 568 aa, Artificial Sequence
  derived and/or modified sequence from Influenza A H3N2 hemagglutinin
MAFLWLLSCWALLGTTFGQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214638 - protein, 567 aa, Artificial Sequence
  derived and/or modified sequence from Influenza A H3N2 hemagglutinin
MGVKVLFALICIAVAEAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214639 - protein, 567 aa, Artificial Sequence; identical to SEQ ID NO: 214638
  derived and/or modified sequence from Influenza A H3N2 hemagglutinin

SEQ ID NO: 214640 - protein, 567 aa, Artificial Sequence
  derived and/or modified sequence from Influenza A H3N2 hemagglutinin
MKAILVVLLYTFATANAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214641 - protein, 574 aa, Artificial Sequence
  derived and/or modified sequence from Influenza A H3N2 hemagglutinin
MALWMRLLPLLALLALWGPDPAAAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214642 - protein, 570 aa, Artificial Sequence
  derived and/or modified sequence from Influenza A H3N2 hemagglutinin
MYRMQLLSCIALSLALVTNSQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214643 - protein, 567 aa, Artificial Sequence
  derived and/or modified sequence from Influenza A H3N2 hemagglutinin
MRAWIFFLLCLAGRALAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214644 - protein, 573 aa, Artificial Sequence
  derived and/or modified sequence from Influenza A H3N2 hemagglutinin
MDAMKRGLCCVLLLCGAVFVSPSQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214645 - protein, 571 aa, Artificial Sequence
  derived and/or modified sequence from Influenza A H3N2 hemagglutinin
MDAMKRGLCCVLLLCGAVFVSQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214646 - protein, 572 aa, Artificial Sequence
  derived and/or modified sequence from Influenza A H3N2 hemagglutinin
MDAMKRGLCCVLLLCGAVFVSPQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214647 - protein, 577 aa, Artificial Sequence
  derived and/or modified sequence from Influenza A H3N2 hemagglutinin
MGVHECPAWLWLLLSLLSLPLGLPVLGQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214648 - protein, 569 aa, Artificial Sequence
  derived and/or modified sequence from Influenza A H3N2 hemagglutinin
MEFGLSWVFLVALFRGVQCQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214649 - protein, 569 aa, Artificial Sequence
  derived and/or modified sequence from Influenza A H3N2 hemagglutinin
MDWTWRVFCLLAVTPGAHPQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214650 - protein, 569 aa, Artificial Sequence
  derived and/or modified sequence from Influenza A H3N2 hemagglutinin
MAWSPLFLTLITHCAGSWAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214651 - protein, 571 aa, Artificial Sequence
  derived and/or modified sequence from Influenza A H3N2 hemagglutinin
METDTLLLWVLLLWVPGSTGDQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214652 - protein, 576 aa, Artificial Sequence
  derived and/or modified sequence from Influenza A H3N2 hemagglutinin
MKTHYSSAILPILTLFVFLSINPSHGQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214653 - protein, 571 aa, Artificial Sequence
  derived and/or modified sequence from Influenza A H3N2 hemagglutinin
MGMRMMFIMFMLVVLATTVVSQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214654 - protein, 570 aa, Artificial Sequence
  derived and/or modified sequence from Influenza A H3N2 hemagglutinin
MARPLCTLLLLMATLAGALAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214655 - protein, 575 aa, Artificial Sequence
  derived and/or modified sequence from Influenza A H3N2 hemagglutinin
MAISGVPVLGFFIIAVLMSAQESWAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 214656 - RNA, 1707 nt, Artificial Sequence
  derived and/or modified sequence opt from Influenza A H3N2 hemagglutinin
augaagugggugaccuucaucagccugcucuuccuguucuccagcgccuacucccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214657 - RNA, 1707 nt, Artificial Sequence
  derived and/or modified sequence opt from Influenza A H3N2 hemagglutinin
auggacuggaccuggauccuguuccucguggccgccgcgacccgcguccacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214658 - RNA, 1725 nt, Artificial Sequence
  derived and/or modified sequence opt from Influenza A H3N2 hemagglutinin
augcccaugggcagccugcagccgcucgccacccuguaccugcucgggaugcugguggccuccugccugggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214659 - RNA, 1725 nt, Artificial Sequence
  derived and/or modified sequence opt from Influenza A H3N2 hemagglutinin
auggccgugauggccccgcggacccugguccuccugcugagcggcgcgcucgcccugacccagacgugggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214660 - RNA, 1728 nt, Artificial Sequence
  derived and/or modified sequence opt from Influenza A H3N2 hemagglutinin
auggccgugauggccccgcggacccugguccuccugcugagcggcgcgcucgcccugacccagacgugggccgggcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214661 - RNA, 1725 nt, Artificial Sequence
  derived and/or modified sequence opt from Influenza A H3N2 hemagglutinin
auggccagcucccuguacagcuuccuccuggcccuguccaucguguacaucuucgucgcgcccacccacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214662 - RNA, 1710 nt, Artificial Sequence
  derived and/or modified sequence opt from Influenza A H3N2 hemagglutinin
augacccgccugaccgugcucgcccugcuggccggccuccuggcgagcucccgggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214663 - RNA, 1701 nt, Artificial Sequence
  derived and/or modified sequence opt from Influenza A H3N2 hemagglutinin
augccccugcuccugcugcucccgcugcugugggccggcgcccucgcgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214664 - RNA, 1710 nt, Artificial Sequence
  derived and/or modified sequence opt from Influenza A H3N2 hemagglutinin
augaucaagcugaaguucggcguguucuucaccguccuccugagcuccgccuacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214665 - RNA, 1707 nt, Artificial Sequence
  derived and/or modified sequence opt from Influenza A H3N2 hemagglutinin
auggccuuccuguggcuccugagcugcugggcccugcucggcaccaccuucgggcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214666 - RNA, 1704 nt, Artificial Sequence
  derived and/or modified sequence opt from Influenza A H3N2 hemagglutinin
augggagugaaaguucuuuuugcccuuauuuguauugcuguggccgaggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214667 - RNA, 1704 nt, Artificial Sequence
  derived and/or modified sequence opt from Influenza A H3N2 hemagglutinin
augggcgugaagguccuguucgcccucaucugcaucgccguggcggaggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214668 - RNA, 1704 nt, Artificial Sequence
  derived and/or modified sequence opt from Influenza A H3N2 hemagglutinin
augaaggccauccuggugguccuccuguacaccuucgccaccgcgaacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214669 - RNA, 1725 nt, Artificial Sequence
  derived and/or modified sequence opt from Influenza A H3N2 hemagglutinin
auggcccuguggaugcgccuccugccccugcucgcccugcuggcgcucuggggcccggaccccgccgccgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214670 - RNA, 1713 nt, Artificial Sequence
  derived and/or modified sequence opt from Influenza A H3N2 hemagglutinin
auguaccggaugcagcugcucagcugcaucgcccugucgcuggcgcucgugaccaacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214671 - RNA, 1704 nt, Artificial Sequence
  derived and/or modified sequence opt from Influenza A H3N2 hemagglutinin
augcgcgccuggaucuucuuccugcucugccuggccggccgggcccuggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214672 - RNA, 1722 nt, Artificial Sequence
  derived and/or modified sequence opt from Influenza A H3N2 hemagglutinin
auggacgccaugaagcgcggccugugcugcgugcuccugcugugcggggccgucuucgugagccccucccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214673 - RNA, 1716 nt, Artificial Sequence
  derived and/or modified sequence opt from Influenza A H3N2 hemagglutinin
auggacgccaugaagcgcggccugugcugcgugcuccugcugugcggggccgucuucgugagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214674 - RNA, 1719 nt, Artificial Sequence
  derived and/or modified sequence opt from Influenza A H3N2 hemagglutinin
auggacgccaugaagcgcggccugugcugcgugcuccugcugugcggggccgucuucgugagcccccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214675 - RNA, 1734 nt, Artificial Sequence
  derived and/or modified sequence opt from Influenza A H3N2 hemagglutinin
augggcgugcacgagugccccgccuggcuguggcuccugcugagccuccugucccugccgcucgggcugcccguccugggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214676 - RNA, 1710 nt, Artificial Sequence
  derived and/or modified sequence opt from Influenza A H3N2 hemagglutinin
auggaguucggccugagcuggguguuccucgucgcccuguuccgcggggugcagugccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214677 - RNA, 1710 nt, Artificial Sequence
  derived and/or modified sequence opt from Influenza A H3N2 hemagglutinin
auggacuggaccuggcgcguguucugccugcucgccgucacccccggcgcccacccgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214678 - RNA, 1710 nt, Artificial Sequence
  derived and/or modified sequence opt from Influenza A H3N2 hemagglutinin
auggccuggagcccccuguuccucacccugaucacccacugcgccggcuccugggcgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214679 - RNA, 1716 nt, Artificial Sequence
  derived and/or modified sequence opt from Influenza A H3N2 hemagglutinin
auggagaccgacacccugcuccugugggugcugcuccuguggguccccggcagcacgggggaccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214680 - RNA, 1731 nt, Artificial Sequence
  derived and/or modified sequence opt from Influenza A H3N2 hemagglutinin
augaagacccacuacagcuccgccauccugcccauccucacccuguucguguuccugagcaucaacccgucccacggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214681 - RNA, 1716 nt, Artificial Sequence
  derived and/or modified sequence opt from Influenza A H3N2 hemagglutinin
augggcaugcgcaugauguucaucauguucaugcuggugguccucgccaccaccguggugagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214682 - RNA, 1713 nt, Artificial Sequence
  derived and/or modified sequence opt from Influenza A H3N2 hemagglutinin
auggcccgcccccugugcacccuccugcugcucauggccacccuggcgggcgcccuggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214683 - RNA, 1728 nt, Artificial Sequence
  derived and/or modified sequence opt from Influenza A H3N2 hemagglutinin
auggccaucagcggcgugcccguccugggguucuucaucaucgccgugcucauguccgcgcaggagagcugggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 214684 - RNA, 1945 nt, Artificial Sequence
  mRNA product opt Design1 from Influenza A H3N2 hemagglutinin
gggagaaagcuuaccauggccgugauggccccgcggacccugguccuccugcugagcggcgcgcucgcccugacccagacgugggccgggcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214685 - RNA, 1942 nt, Artificial Sequence
  mRNA product opt Design1 from Influenza A H3N2 hemagglutinin
gggagaaagcuuaccauggccagcucccuguacagcuuccuccuggcccuguccaucguguacaucuucgucgcgcccacccacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214686 - RNA, 1927 nt, Artificial Sequence
  mRNA product opt Design1 from Influenza A H3N2 hemagglutinin
gggagaaagcuuaccaugacccgccugaccgugcucgcccugcuggccggccuccuggcgagcucccgggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214687 - RNA, 1918 nt, Artificial Sequence
  mRNA product opt Design1 from Influenza A H3N2 hemagglutinin
gggagaaagcuuaccaugccccugcuccugcugcucccgcugcugugggccggcgcccucgcgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214688 - RNA, 1927 nt, Artificial Sequence
  mRNA product opt Design1 from Influenza A H3N2 hemagglutinin
gggagaaagcuuaccaugaucaagcugaaguucggcguguucuucaccguccuccugagcuccgccuacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214689 - RNA, 1924 nt, Artificial Sequence
  mRNA product opt Design1 from Influenza A H3N2 hemagglutinin
gggagaaagcuuaccauggccuuccuguggcuccugagcugcugggcccugcucggcaccaccuucgggcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214690 - RNA, 1921 nt, Artificial Sequence
  mRNA product opt Design1 from Influenza A H3N2 hemagglutinin
gggagaaagcuuaccaugggagugaaaguucuuuuugcccuuauuuguauugcuguggccgaggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214691 - RNA, 1921 nt, Artificial Sequence
  mRNA product opt Design1 from Influenza A H3N2 hemagglutinin
gggagaaagcuuaccaugggcgugaagguccuguucgcccucaucugcaucgccguggcggaggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214692 - RNA, 1921 nt, Artificial Sequence
  mRNA product opt Design1 from Influenza A H3N2 hemagglutinin
gggagaaagcuuaccaugaaggccauccuggugguccuccuguacaccuucgccaccgcgaacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214693 - RNA, 1942 nt, Artificial Sequence
  mRNA product opt Design1 from Influenza A H3N2 hemagglutinin
gggagaaagcuuaccauggcccuguggaugcgccuccugccccugcucgcccugcuggcgcucuggggcccggaccccgccgccgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214694 - RNA, 1930 nt, Artificial Sequence
  mRNA product opt Design1 from Influenza A H3N2 hemagglutinin
gggagaaagcuuaccauguaccggaugcagcugcucagcugcaucgcccugucgcuggcgcucgugaccaacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214695 - RNA, 1921 nt, Artificial Sequence
  mRNA product opt Design1 from Influenza A H3N2 hemagglutinin
gggagaaagcuuaccaugcgcgccuggaucuucuuccugcucugccuggccggccgggcccuggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214696 - RNA, 1939 nt, Artificial Sequence
  mRNA product opt Design1 from Influenza A H3N2 hemagglutinin
gggagaaagcuuaccauggacgccaugaagcgcggccugugcugcgugcuccugcugugcggggccgucuucgugagccccucccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214697 - RNA, 1933 nt, Artificial Sequence
  mRNA product opt Design1 from Influenza A H3N2 hemagglutinin
gggagaaagcuuaccauggacgccaugaagcgcggccugugcugcgugcuccugcugugcggggccgucuucgugagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214698 - RNA, 1936 nt, Artificial Sequence
  mRNA product opt Design1 from Influenza A H3N2 hemagglutinin
gggagaaagcuuaccauggacgccaugaagcgcggccugugcugcgugcuccugcugugcggggccgucuucgugagcccccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214699 - RNA, 1951 nt, Artificial Sequence
  mRNA product opt Design1 from Influenza A H3N2 hemagglutinin
gggagaaagcuuaccaugggcgugcacgagugccccgccuggcuguggcuccugcugagccuccugucccugccgcucgggcugcccguccugggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214700 - RNA, 1927 nt, Artificial Sequence
  mRNA product opt Design1 from Influenza A H3N2 hemagglutinin
gggagaaagcuuaccauggaguucggccugagcuggguguuccucgucgcccuguuccgcggggugcagugccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214701 - RNA, 1927 nt, Artificial Sequence
  mRNA product opt Design1 from Influenza A H3N2 hemagglutinin
gggagaaagcuuaccauggacuggaccuggcgcguguucugccugcucgccgucacccccggcgcccacccgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214702 - RNA, 1927 nt, Artificial Sequence
  mRNA product opt Design1 from Influenza A H3N2 hemagglutinin
gggagaaagcuuaccauggccuggagcccccuguuccucacccugaucacccacugcgccggcuccugggcgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214703 - RNA, 1933 nt, Artificial Sequence
  mRNA product opt Design1 from Influenza A H3N2 hemagglutinin
gggagaaagcuuaccauggagaccgacacccugcuccugugggugcugcuccuguggguccccggcagcacgggggaccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214704 - RNA, 1948 nt, Artificial Sequence
  mRNA product opt Design1 from Influenza A H3N2 hemagglutinin
gggagaaagcuuaccaugaagacccacuacagcuccgccauccugcccauccucacccuguucguguuccugagcaucaacccgucccacggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214705 - RNA, 1933 nt, Artificial Sequence
  mRNA product opt Design1 from Influenza A H3N2 hemagglutinin
gggagaaagcuuaccaugggcaugcgcaugauguucaucauguucaugcuggugguccucgccaccaccguggugagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214706 - RNA, 1930 nt, Artificial Sequence
  mRNA product opt Design1 from Influenza A H3N2 hemagglutinin
gggagaaagcuuaccauggcccgcccccugugcacccuccugcugcucauggccacccuggcgggcgcccuggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214707 - RNA, 1945 nt, Artificial Sequence
  mRNA product opt Design1 from Influenza A H3N2 hemagglutinin
gggagaaagcuuaccauggccaucagcggcgugcccguccugggguucuucaucaucgccgugcucauguccgcgcaggagagcugggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214708 - RNA, 2110 nt, Artificial Sequence
  mRNA product opt Design2 from Influenza A H3N2 hemagglutinin
ggggcgcugccuacggagguggcagccaucuccuucucggcaucaagcuuaccauggccgugauggccccgcggacccugguccuccugcugagcggcgcgcucgcccugacccagacgugggccgggcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214709 - RNA, 2107 nt, Artificial Sequence
  mRNA product opt Design2 from Influenza A H3N2 hemagglutinin
ggggcgcugccuacggagguggcagccaucuccuucucggcaucaagcuuaccauggccagcucccuguacagcuuccuccuggcccuguccaucguguacaucuucgucgcgcccacccacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214710 - RNA, 2092 nt, Artificial Sequence
  mRNA product opt Design2 from Influenza A H3N2 hemagglutinin
ggggcgcugccuacggagguggcagccaucuccuucucggcaucaagcuuaccaugacccgccugaccgugcucgcccugcuggccggccuccuggcgagcucccgggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214711 - RNA, 2083 nt, Artificial Sequence
  mRNA product opt Design2 from Influenza A H3N2 hemagglutinin
ggggcgcugccuacggagguggcagccaucuccuucucggcaucaagcuuaccaugccccugcuccugcugcucccgcugcugugggccggcgcccucgcgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214712 - RNA, 2092 nt, Artificial Sequence
  mRNA product opt Design2 from Influenza A H3N2 hemagglutinin
ggggcgcugccuacggagguggcagccaucuccuucucggcaucaagcuuaccaugaucaagcugaaguucggcguguucuucaccguccuccugagcuccgccuacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214713 - RNA, 2089 nt, Artificial Sequence
  mRNA product opt Design2 from Influenza A H3N2 hemagglutinin
ggggcgcugccuacggagguggcagccaucuccuucucggcaucaagcuuaccauggccuuccuguggcuccugagcugcugggcccugcucggcaccaccuucgggcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214714 - RNA, 2086 nt, Artificial Sequence
  mRNA product opt Design2 from Influenza A H3N2 hemagglutinin
ggggcgcugccuacggagguggcagccaucuccuucucggcaucaagcuuaccaugggagugaaaguucuuuuugcccuuauuuguauugcuguggccgaggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214715 - RNA, 2086 nt, Artificial Sequence
  mRNA product opt Design2 from Influenza A H3N2 hemagglutinin
ggggcgcugccuacggagguggcagccaucuccuucucggcaucaagcuuaccaugggcgugaagguccuguucgcccucaucugcaucgccguggcggaggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214716 - RNA, 2086 nt, Artificial Sequence
  mRNA product opt Design2 from Influenza A H3N2 hemagglutinin
ggggcgcugccuacggagguggcagccaucuccuucucggcaucaagcuuaccaugaaggccauccuggugguccuccuguacaccuucgccaccgcgaacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214717 - RNA, 2107 nt, Artificial Sequence
  mRNA product opt Design2 from Influenza A H3N2 hemagglutinin
ggggcgcugccuacggagguggcagccaucuccuucucggcaucaagcuuaccauggcccuguggaugcgccuccugccccugcucgcccugcuggcgcucuggggcccggaccccgccgccgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214718 - RNA, 2095 nt, Artificial Sequence
  mRNA product opt Design2 from Influenza A H3N2 hemagglutinin
ggggcgcugccuacggagguggcagccaucuccuucucggcaucaagcuuaccauguaccggaugcagcugcucagcugcaucgcccugucgcuggcgcucgugaccaacagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214719 - RNA, 2086 nt, Artificial Sequence
  mRNA product opt Design2 from Influenza A H3N2 hemagglutinin
ggggcgcugccuacggagguggcagccaucuccuucucggcaucaagcuuaccaugcgcgccuggaucuucuuccugcucugccuggccggccgggcccuggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214720 - RNA, 2104 nt, Artificial Sequence
  mRNA product opt Design2 from Influenza A H3N2 hemagglutinin
ggggcgcugccuacggagguggcagccaucuccuucucggcaucaagcuuaccauggacgccaugaagcgcggccugugcugcgugcuccugcugugcggggccgucuucgugagccccucccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214721 - RNA, 2098 nt, Artificial Sequence
  mRNA product opt Design2 from Influenza A H3N2 hemagglutinin
ggggcgcugccuacggagguggcagccaucuccuucucggcaucaagcuuaccauggacgccaugaagcgcggccugugcugcgugcuccugcugugcggggccgucuucgugagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214722 - RNA, 2101 nt, Artificial Sequence
  mRNA product opt Design2 from Influenza A H3N2 hemagglutinin
ggggcgcugccuacggagguggcagccaucuccuucucggcaucaagcuuaccauggacgccaugaagcgcggccugugcugcgugcuccugcugugcggggccgucuucgugagcccccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214723 - RNA, 2116 nt, Artificial Sequence
  mRNA product opt Design2 from Influenza A H3N2 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214724 - RNA, 2092 nt, Artificial Sequence
  mRNA product opt Design2 from Influenza A H3N2 hemagglutinin
ggggcgcugccuacggagguggcagccaucuccuucucggcaucaagcuuaccauggaguucggccugagcuggguguuccucgucgcccuguuccgcggggugcagugccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214725 - RNA, 2092 nt, Artificial Sequence
  mRNA product opt Design2 from Influenza A H3N2 hemagglutinin
ggggcgcugccuacggagguggcagccaucuccuucucggcaucaagcuuaccauggacuggaccuggcgcguguucugccugcucgccgucacccccggcgcccacccgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214726 - RNA, 2092 nt, Artificial Sequence
  mRNA product opt Design2 from Influenza A H3N2 hemagglutinin
ggggcgcugccuacggagguggcagccaucuccuucucggcaucaagcuuaccauggccuggagcccccuguuccucacccugaucacccacugcgccggcuccugggcgcagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214727 - RNA, 2098 nt, Artificial Sequence
  mRNA product opt Design2 from Influenza A H3N2 hemagglutinin
ggggcgcugccuacggagguggcagccaucuccuucucggcaucaagcuuaccauggagaccgacacccugcuccugugggugcugcuccuguggguccccggcagcacgggggaccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214728 - RNA, 2113 nt, Artificial Sequence
  mRNA product opt Design2 from Influenza A H3N2 hemagglutinin
ggggcgcugccuacggagguggcagccaucuccuucucggcaucaagcuuaccaugaagacccacuacagcuccgccauccugcccauccucacccuguucguguuccugagcaucaacccgucccacggccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214729 - RNA, 2098 nt, Artificial Sequence
  mRNA product opt Design2 from Influenza A H3N2 hemagglutinin
ggggcgcugccuacggagguggcagccaucuccuucucggcaucaagcuuaccaugggcaugcgcaugauguucaucauguucaugcuggugguccucgccaccaccguggugagccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214730 - RNA, 2095 nt, Artificial Sequence
  mRNA product opt Design2 from Influenza A H3N2 hemagglutinin
ggggcgcugccuacggagguggcagccaucuccuucucggcaucaagcuuaccauggcccgcccccugugcacccuccugcugcucauggccacccuggcgggcgcccuggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214731 - RNA, 2110 nt, Artificial Sequence
  mRNA product opt Design2 from Influenza A H3N2 hemagglutinin
ggggcgcugccuacggagguggcagccaucuccuucucggcaucaagcuuaccauggccaucagcggcgugcccguccugggguucuucaucaucgccgugcucauguccgcgcaggagagcugggcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214732 - protein, 570 aa, Artificial Sequence
  derived and/or modified sequence from Influenza A H5N1 hemagglutinin
MKWVTFISLLFLFSSAYSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214733 - protein, 570 aa, Artificial Sequence
  derived and/or modified sequence from Influenza A H5N1 hemagglutinin
MDWTWILFLVAAATRVHSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214734 - protein, 576 aa, Artificial Sequence
  derived and/or modified sequence from Influenza A H5N1 hemagglutinin
MPMGSLQPLATLYLLGMLVASCLGDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214735 - protein, 576 aa, Artificial Sequence
  derived and/or modified sequence from Influenza A H5N1 hemagglutinin
MAVMAPRTLVLLLSGALALTQTWADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214736 - protein, 577 aa, Artificial Sequence
  derived and/or modified sequence from Influenza A H5N1 hemagglutinin
MAVMAPRTLVLLLSGALALTQTWAGDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214737 - protein, 576 aa, Artificial Sequence
  derived and/or modified sequence from Influenza A H5N1 hemagglutinin
MASSLYSFLLALSIVYIFVAPTHSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214738 - protein, 571 aa, Artificial Sequence
  derived and/or modified sequence from Influenza A H5N1 hemagglutinin
MTRLTVLALLAGLLASSRADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214739 - protein, 568 aa, Artificial Sequence
  derived and/or modified sequence from Influenza A H5N1 hemagglutinin
MPLLLLLPLLWAGALADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214740 - protein, 571 aa, Artificial Sequence
  derived and/or modified sequence from Influenza A H5N1 hemagglutinin
MIKLKFGVFFTVLLSSAYADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214741 - protein, 570 aa, Artificial Sequence
  derived and/or modified sequence from Influenza A H5N1 hemagglutinin
MAFLWLLSCWALLGTTFGDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214742 - protein, 569 aa, Artificial Sequence
  derived and/or modified sequence from Influenza A H5N1 hemagglutinin
MGVKVLFALICIAVAEADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214743 - protein, 569 aa, Artificial Sequence; identical to SEQ ID NO: 214742
  derived and/or modified sequence from Influenza A H5N1 hemagglutinin

SEQ ID NO: 214744 - protein, 569 aa, Artificial Sequence
  derived and/or modified sequence from Influenza A H5N1 hemagglutinin
MKAILVVLLYTFATANADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214745 - protein, 576 aa, Artificial Sequence
  derived and/or modified sequence from Influenza A H5N1 hemagglutinin
MALWMRLLPLLALLALWGPDPAAADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214746 - protein, 572 aa, Artificial Sequence
  derived and/or modified sequence from Influenza A H5N1 hemagglutinin
MYRMQLLSCIALSLALVTNSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214747 - protein, 569 aa, Artificial Sequence
  derived and/or modified sequence from Influenza A H5N1 hemagglutinin
MRAWIFFLLCLAGRALADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214748 - protein, 575 aa, Artificial Sequence
  derived and/or modified sequence from Influenza A H5N1 hemagglutinin
MDAMKRGLCCVLLLCGAVFVSPSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214749 - protein, 573 aa, Artificial Sequence
  derived and/or modified sequence from Influenza A H5N1 hemagglutinin
MDAMKRGLCCVLLLCGAVFVSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214750 - protein, 574 aa, Artificial Sequence
  derived and/or modified sequence from Influenza A H5N1 hemagglutinin
MDAMKRGLCCVLLLCGAVFVSPDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214751 - protein, 579 aa, Artificial Sequence
  derived and/or modified sequence from Influenza A H5N1 hemagglutinin
MGVHECPAWLWLLLSLLSLPLGLPVLGDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214752 - protein, 571 aa, Artificial Sequence
  derived and/or modified sequence from Influenza A H5N1 hemagglutinin
MEFGLSWVFLVALFRGVQCDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214753 - protein, 571 aa, Artificial Sequence
  derived and/or modified sequence from Influenza A H5N1 hemagglutinin
MDWTWRVFCLLAVTPGAHPDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214754 - protein, 571 aa, Artificial Sequence
  derived and/or modified sequence from Influenza A H5N1 hemagglutinin
MAWSPLFLTLITHCAGSWADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214755 - protein, 573 aa, Artificial Sequence
  derived and/or modified sequence from Influenza A H5N1 hemagglutinin
METDTLLLWVLLLWVPGSTGDDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214756 - protein, 578 aa, Artificial Sequence
  derived and/or modified sequence from Influenza A H5N1 hemagglutinin
MKTHYSSAILPILTLFVFLSINPSHGDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214757 - protein, 573 aa, Artificial Sequence
  derived and/or modified sequence from Influenza A H5N1 hemagglutinin
MGMRMMFIMFMLVVLATTVVSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214758 - protein, 572 aa, Artificial Sequence
  derived and/or modified sequence from Influenza A H5N1 hemagglutinin
MARPLCTLLLLMATLAGALADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214759 - protein, 577 aa, Artificial Sequence
  derived and/or modified sequence from Influenza A H5N1 hemagglutinin
MAISGVPVLGFFIIAVLMSAQESWADQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 214760 - RNA, 1713 nt, Artificial Sequence
  derived and/or modified sequence opt from Influenza A H5N1 hemagglutinin
augaagugggugaccuucaucagccugcucuuccuguucuccagcgccuacuccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214761 - RNA, 1713 nt, Artificial Sequence
  derived and/or modified sequence opt from Influenza A H5N1 hemagglutinin
auggacuggaccuggauccuguuccucguggccgccgcgacccgcguccacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214762 - RNA, 1731 nt, Artificial Sequence
  derived and/or modified sequence opt from Influenza A H5N1 hemagglutinin
augcccaugggcagccugcagccgcucgccacccuguaccugcucgggaugcugguggccuccugccugggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214763 - RNA, 1731 nt, Artificial Sequence
  derived and/or modified sequence opt from Influenza A H5N1 hemagglutinin
auggccgugauggccccgcggacccugguccuccugcugagcggcgcgcucgcccugacccagacgugggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214764 - RNA, 1734 nt, Artificial Sequence
  derived and/or modified sequence opt from Influenza A H5N1 hemagglutinin
auggccgugauggccccgcggacccugguccuccugcugagcggcgcgcucgcccugacccagacgugggccggggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214765 - RNA, 1731 nt, Artificial Sequence
  derived and/or modified sequence opt from Influenza A H5N1 hemagglutinin
auggccagcucccuguacagcuuccuccuggcccuguccaucguguacaucuucgucgcgcccacccacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214766 - RNA, 1716 nt, Artificial Sequence
  derived and/or modified sequence opt from Influenza A H5N1 hemagglutinin
augacccgccugaccgugcucgcccugcuggccggccuccuggcgagcucccgggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214767 - RNA, 1707 nt, Artificial Sequence
  derived and/or modified sequence opt from Influenza A H5N1 hemagglutinin
augccccugcuccugcugcucccgcugcugugggccggcgcccucgcggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214768 - RNA, 1716 nt, Artificial Sequence
  derived and/or modified sequence opt from Influenza A H5N1 hemagglutinin
augaucaagcugaaguucggcguguucuucaccguccuccugagcuccgccuacgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214769 - RNA, 1713 nt, Artificial Sequence
  derived and/or modified sequence opt from Influenza A H5N1 hemagglutinin
auggccuuccuguggcuccugagcugcugggcccugcucggcaccaccuucggggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214770 - RNA, 1710 nt, Artificial Sequence
  derived and/or modified sequence opt from Influenza A H5N1 hemagglutinin
augggagugaaaguucuuuuugcccuuauuuguauugcuguggccgaggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214771 - RNA, 1710 nt, Artificial Sequence
  derived and/or modified sequence opt from Influenza A H5N1 hemagglutinin
augggcgugaagguccuguucgcccucaucugcaucgccguggcggaggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214772 - RNA, 1710 nt, Artificial Sequence
  derived and/or modified sequence opt from Influenza A H5N1 hemagglutinin
augaaggccauccuggugguccuccuguacaccuucgccaccgcgaacgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214773 - RNA, 1731 nt, Artificial Sequence
  derived and/or modified sequence opt from Influenza A H5N1 hemagglutinin
auggcccuguggaugcgccuccugccccugcucgcccugcuggcgcucuggggcccggaccccgccgccgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214774 - RNA, 1719 nt, Artificial Sequence
  derived and/or modified sequence opt from Influenza A H5N1 hemagglutinin
auguaccggaugcagcugcucagcugcaucgcccugucgcuggcgcucgugaccaacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214775 - RNA, 1710 nt, Artificial Sequence
  derived and/or modified sequence opt from Influenza A H5N1 hemagglutinin
augcgcgccuggaucuucuuccugcucugccuggccggccgggcccuggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214776 - RNA, 1728 nt, Artificial Sequence
  derived and/or modified sequence opt from Influenza A H5N1 hemagglutinin
auggacgccaugaagcgcggccugugcugcgugcuccugcugugcggggccgucuucgugagccccuccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214777 - RNA, 1722 nt, Artificial Sequence
  derived and/or modified sequence opt from Influenza A H5N1 hemagglutinin
auggacgccaugaagcgcggccugugcugcgugcuccugcugugcggggccgucuucgugagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214778 - RNA, 1725 nt, Artificial Sequence
  derived and/or modified sequence opt from Influenza A H5N1 hemagglutinin
auggacgccaugaagcgcggccugugcugcgugcuccugcugugcggggccgucuucgugagccccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214779 - RNA, 1740 nt, Artificial Sequence
  derived and/or modified sequence opt from Influenza A H5N1 hemagglutinin
augggcgugcacgagugccccgccuggcuguggcuccugcugagccuccugucccugccgcucgggcugcccguccugggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214780 - RNA, 1716 nt, Artificial Sequence
  derived and/or modified sequence opt from Influenza A H5N1 hemagglutinin
auggaguucggccugagcuggguguuccucgucgcccuguuccgcggggugcagugcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214781 - RNA, 1716 nt, Artificial Sequence
  derived and/or modified sequence opt from Influenza A H5N1 hemagglutinin
auggacuggaccuggcgcguguucugccugcucgccgucacccccggcgcccacccggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214782 - RNA, 1716 nt, Artificial Sequence
  derived and/or modified sequence opt from Influenza A H5N1 hemagglutinin
auggccuggagcccccuguuccucacccugaucacccacugcgccggcuccugggcggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214783 - RNA, 1722 nt, Artificial Sequence
  derived and/or modified sequence opt from Influenza A H5N1 hemagglutinin
auggagaccgacacccugcuccugugggugcugcuccuguggguccccggcagcacgggggacgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214784 - RNA, 1737 nt, Artificial Sequence
  derived and/or modified sequence opt from Influenza A H5N1 hemagglutinin
augaagacccacuacagcuccgccauccugcccauccucacccuguucguguuccugagcaucaacccgucccacggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214785 - RNA, 1722 nt, Artificial Sequence
  derived and/or modified sequence opt from Influenza A H5N1 hemagglutinin
augggcaugcgcaugauguucaucauguucaugcuggugguccucgccaccaccguggugagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214786 - RNA, 1719 nt, Artificial Sequence
  derived and/or modified sequence opt from Influenza A H5N1 hemagglutinin
auggcccgcccccugugcacccuccugcugcucauggccacccuggcgggcgcccuggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214787 - RNA, 1734 nt, Artificial Sequence
  derived and/or modified sequence opt from Influenza A H5N1 hemagglutinin
auggccaucagcggcgugcccguccugggguucuucaucaucgccgugcucauguccgcgcaggagagcugggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucuga

SEQ ID NO: 214788 - RNA, 1951 nt, Artificial Sequence
  mRNA product opt Design1 from Influenza A H5N1 hemagglutinin
gggagaaagcuuaccauggccgugauggccccgcggacccugguccuccugcugagcggcgcgcucgcccugacccagacgugggccggggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214789 - RNA, 1948 nt, Artificial Sequence
  mRNA product opt Design1 from Influenza A H5N1 hemagglutinin
gggagaaagcuuaccauggccagcucccuguacagcuuccuccuggcccuguccaucguguacaucuucgucgcgcccacccacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214790 - RNA, 1933 nt, Artificial Sequence
  mRNA product opt Design1 from Influenza A H5N1 hemagglutinin
gggagaaagcuuaccaugacccgccugaccgugcucgcccugcuggccggccuccuggcgagcucccgggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214791 - RNA, 1924 nt, Artificial Sequence
  mRNA product opt Design1 from Influenza A H5N1 hemagglutinin
gggagaaagcuuaccaugccccugcuccugcugcucccgcugcugugggccggcgcccucgcggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214792 - RNA, 1933 nt, Artificial Sequence
  mRNA product opt Design1 from Influenza A H5N1 hemagglutinin
gggagaaagcuuaccaugaucaagcugaaguucggcguguucuucaccguccuccugagcuccgccuacgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214793 - RNA, 1930 nt, Artificial Sequence
  mRNA product opt Design1 from Influenza A H5N1 hemagglutinin
gggagaaagcuuaccauggccuuccuguggcuccugagcugcugggcccugcucggcaccaccuucggggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214794 - RNA, 1927 nt, Artificial Sequence
  mRNA product opt Design1 from Influenza A H5N1 hemagglutinin
gggagaaagcuuaccaugggagugaaaguucuuuuugcccuuauuuguauugcuguggccgaggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214795 - RNA, 1927 nt, Artificial Sequence
  mRNA product opt Design1 from Influenza A H5N1 hemagglutinin
gggagaaagcuuaccaugggcgugaagguccuguucgcccucaucugcaucgccguggcggaggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214796 - RNA, 1927 nt, Artificial Sequence
  mRNA product opt Design1 from Influenza A H5N1 hemagglutinin
gggagaaagcuuaccaugaaggccauccuggugguccuccuguacaccuucgccaccgcgaacgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214797 - RNA, 1948 nt, Artificial Sequence
  mRNA product opt Design1 from Influenza A H5N1 hemagglutinin
gggagaaagcuuaccauggcccuguggaugcgccuccugccccugcucgcccugcuggcgcucuggggcccggaccccgccgccgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214798 - RNA, 1936 nt, Artificial Sequence
  mRNA product opt Design1 from Influenza A H5N1 hemagglutinin
gggagaaagcuuaccauguaccggaugcagcugcucagcugcaucgcccugucgcuggcgcucgugaccaacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214799 - RNA, 1927 nt, Artificial Sequence
  mRNA product opt Design1 from Influenza A H5N1 hemagglutinin
gggagaaagcuuaccaugcgcgccuggaucuucuuccugcucugccuggccggccgggcccuggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214800 - RNA, 1945 nt, Artificial Sequence
  mRNA product opt Design1 from Influenza A H5N1 hemagglutinin
gggagaaagcuuaccauggacgccaugaagcgcggccugugcugcgugcuccugcugugcggggccgucuucgugagccccuccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214801 - RNA, 1939 nt, Artificial Sequence
  mRNA product opt Design1 from Influenza A H5N1 hemagglutinin
gggagaaagcuuaccauggacgccaugaagcgcggccugugcugcgugcuccugcugugcggggccgucuucgugagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214802 - RNA, 1942 nt, Artificial Sequence
  mRNA product opt Design1 from Influenza A H5N1 hemagglutinin
gggagaaagcuuaccauggacgccaugaagcgcggccugugcugcgugcuccugcugugcggggccgucuucgugagccccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214803 - RNA, 1957 nt, Artificial Sequence
  mRNA product opt Design1 from Influenza A H5N1 hemagglutinin
gggagaaagcuuaccaugggcgugcacgagugccccgccuggcuguggcuccugcugagccuccugucccugccgcucgggcugcccguccugggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214804 - RNA, 1933 nt, Artificial Sequence
  mRNA product opt Design1 from Influenza A H5N1 hemagglutinin
gggagaaagcuuaccauggaguucggccugagcuggguguuccucgucgcccuguuccgcggggugcagugcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214805 - RNA, 1933 nt, Artificial Sequence
  mRNA product opt Design1 from Influenza A H5N1 hemagglutinin
gggagaaagcuuaccauggacuggaccuggcgcguguucugccugcucgccgucacccccggcgcccacccggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214806 - RNA, 1933 nt, Artificial Sequence
  mRNA product opt Design1 from Influenza A H5N1 hemagglutinin
gggagaaagcuuaccauggccuggagcccccuguuccucacccugaucacccacugcgccggcuccugggcggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214807 - RNA, 1939 nt, Artificial Sequence
  mRNA product opt Design1 from Influenza A H5N1 hemagglutinin
gggagaaagcuuaccauggagaccgacacccugcuccugugggugcugcuccuguggguccccggcagcacgggggacgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214808 - RNA, 1954 nt, Artificial Sequence
  mRNA product opt Design1 from Influenza A H5N1 hemagglutinin
gggagaaagcuuaccaugaagacccacuacagcuccgccauccugcccauccucacccuguucguguuccugagcaucaacccgucccacggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214809 - RNA, 1939 nt, Artificial Sequence
  mRNA product opt Design1 from Influenza A H5N1 hemagglutinin
gggagaaagcuuaccaugggcaugcgcaugauguucaucauguucaugcuggugguccucgccaccaccguggugagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214810 - RNA, 1936 nt, Artificial Sequence
  mRNA product opt Design1 from Influenza A H5N1 hemagglutinin
gggagaaagcuuaccauggcccgcccccugugcacccuccugcugcucauggccacccuggcgggcgcccuggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214811 - RNA, 1951 nt, Artificial Sequence
  mRNA product opt Design1 from Influenza A H5N1 hemagglutinin
gggagaaagcuuaccauggccaucagcggcgugcccguccugggguucuucaucaucgccgugcucauguccgcgcaggagagcugggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214812 - RNA, 2116 nt, Artificial Sequence
  mRNA product opt Design2 from Influenza A H5N1 hemagglutinin
ggggcgcugccuacggagguggcagccaucuccuucucggcaucaagcuuaccauggccgugauggccccgcggacccugguccuccugcugagcggcgcgcucgcccugacccagacgugggccggggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214813 - RNA, 2113 nt, Artificial Sequence
  mRNA product opt Design2 from Influenza A H5N1 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214814 - RNA, 2098 nt, Artificial Sequence
  mRNA product opt Design2 from Influenza A H5N1 hemagglutinin
ggggcgcugccuacggagguggcagccaucuccuucucggcaucaagcuuaccaugacccgccugaccgugcucgcccugcuggccggccuccuggcgagcucccgggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214815 - RNA, 2089 nt, Artificial Sequence
  mRNA product opt Design2 from Influenza A H5N1 hemagglutinin
ggggcgcugccuacggagguggcagccaucuccuucucggcaucaagcuuaccaugccccugcuccugcugcucccgcugcugugggccggcgcccucgcggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214816 - RNA, 2098 nt, Artificial Sequence
  mRNA product opt Design2 from Influenza A H5N1 hemagglutinin
ggggcgcugccuacggagguggcagccaucuccuucucggcaucaagcuuaccaugaucaagcugaaguucggcguguucuucaccguccuccugagcuccgccuacgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214817 - RNA, 2095 nt, Artificial Sequence
  mRNA product opt Design2 from Influenza A H5N1 hemagglutinin
ggggcgcugccuacggagguggcagccaucuccuucucggcaucaagcuuaccauggccuuccuguggcuccugagcugcugggcccugcucggcaccaccuucggggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214818 - RNA, 2092 nt, Artificial Sequence
  mRNA product opt Design2 from Influenza A H5N1 hemagglutinin
ggggcgcugccuacggagguggcagccaucuccuucucggcaucaagcuuaccaugggagugaaaguucuuuuugcccuuauuuguauugcuguggccgaggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214819 - RNA, 2092 nt, Artificial Sequence
  mRNA product opt Design2 from Influenza A H5N1 hemagglutinin
ggggcgcugccuacggagguggcagccaucuccuucucggcaucaagcuuaccaugggcgugaagguccuguucgcccucaucugcaucgccguggcggaggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214820 - RNA, 2092 nt, Artificial Sequence
  mRNA product opt Design2 from Influenza A H5N1 hemagglutinin
ggggcgcugccuacggagguggcagccaucuccuucucggcaucaagcuuaccaugaaggccauccuggugguccuccuguacaccuucgccaccgcgaacgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214821 - RNA, 2113 nt, Artificial Sequence
  mRNA product opt Design2 from Influenza A H5N1 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214822 - RNA, 2101 nt, Artificial Sequence
  mRNA product opt Design2 from Influenza A H5N1 hemagglutinin
ggggcgcugccuacggagguggcagccaucuccuucucggcaucaagcuuaccauguaccggaugcagcugcucagcugcaucgcccugucgcuggcgcucgugaccaacagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214823 - RNA, 2092 nt, Artificial Sequence
  mRNA product opt Design2 from Influenza A H5N1 hemagglutinin
ggggcgcugccuacggagguggcagccaucuccuucucggcaucaagcuuaccaugcgcgccuggaucuucuuccugcucugccuggccggccgggcccuggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214824 - RNA, 2110 nt, Artificial Sequence
  mRNA product opt Design2 from Influenza A H5N1 hemagglutinin
ggggcgcugccuacggagguggcagccaucuccuucucggcaucaagcuuaccauggacgccaugaagcgcggccugugcugcgugcuccugcugugcggggccgucuucgugagccccuccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214825 - RNA, 2104 nt, Artificial Sequence
  mRNA product opt Design2 from Influenza A H5N1 hemagglutinin
ggggcgcugccuacggagguggcagccaucuccuucucggcaucaagcuuaccauggacgccaugaagcgcggccugugcugcgugcuccugcugugcggggccgucuucgugagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214826 - RNA, 2107 nt, Artificial Sequence
  mRNA product opt Design2 from Influenza A H5N1 hemagglutinin
ggggcgcugccuacggagguggcagccaucuccuucucggcaucaagcuuaccauggacgccaugaagcgcggccugugcugcgugcuccugcugugcggggccgucuucgugagccccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214827 - RNA, 2122 nt, Artificial Sequence
  mRNA product opt Design2 from Influenza A H5N1 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214828 - RNA, 2098 nt, Artificial Sequence
  mRNA product opt Design2 from Influenza A H5N1 hemagglutinin
ggggcgcugccuacggagguggcagccaucuccuucucggcaucaagcuuaccauggaguucggccugagcuggguguuccucgucgcccuguuccgcggggugcagugcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214829 - RNA, 2098 nt, Artificial Sequence
  mRNA product opt Design2 from Influenza A H5N1 hemagglutinin
ggggcgcugccuacggagguggcagccaucuccuucucggcaucaagcuuaccauggacuggaccuggcgcguguucugccugcucgccgucacccccggcgcccacccggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214830 - RNA, 2098 nt, Artificial Sequence
  mRNA product opt Design2 from Influenza A H5N1 hemagglutinin
ggggcgcugccuacggagguggcagccaucuccuucucggcaucaagcuuaccauggccuggagcccccuguuccucacccugaucacccacugcgccggcuccugggcggaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214831 - RNA, 2104 nt, Artificial Sequence
  mRNA product opt Design2 from Influenza A H5N1 hemagglutinin
ggggcgcugccuacggagguggcagccaucuccuucucggcaucaagcuuaccauggagaccgacacccugcuccugugggugcugcuccuguggguccccggcagcacgggggacgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214832 - RNA, 2119 nt, Artificial Sequence
  mRNA product opt Design2 from Influenza A H5N1 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214833 - RNA, 2104 nt, Artificial Sequence
  mRNA product opt Design2 from Influenza A H5N1 hemagglutinin
ggggcgcugccuacggagguggcagccaucuccuucucggcaucaagcuuaccaugggcaugcgcaugauguucaucauguucaugcuggugguccucgccaccaccguggugagcgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214834 - RNA, 2101 nt, Artificial Sequence
  mRNA product opt Design2 from Influenza A H5N1 hemagglutinin
ggggcgcugccuacggagguggcagccaucuccuucucggcaucaagcuuaccauggcccgcccccugugcacccuccugcugcucauggccacccuggcgggcgcccuggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214835 - RNA, 2116 nt, Artificial Sequence
  mRNA product opt Design2 from Influenza A H5N1 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccagccugggcguguccagcgccugccccuaccagggcaaguccagcuucuuccggaacguggucuggcugaucaagaagaacuccaccuaccccacgaucaagcgcagcuacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagagcaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacagcccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcacguacgacuacccccaguacuccgaggaggcccgccucaagcgggaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214836 - protein, 588 aa, Artificial Sequence
  derived and/or modified sequence from Influenza B hemagglutinin
MKWVTFISLLFLFSSAYSDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214837 - protein, 588 aa, Artificial Sequence
  derived and/or modified sequence from Influenza B hemagglutinin
MDWTWILFLVAAATRVHSDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214838 - protein, 594 aa, Artificial Sequence
  derived and/or modified sequence from Influenza B hemagglutinin
MPMGSLQPLATLYLLGMLVASCLGDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214839 - protein, 594 aa, Artificial Sequence
  derived and/or modified sequence from Influenza B hemagglutinin
MAVMAPRTLVLLLSGALALTQTWADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214840 - protein, 595 aa, Artificial Sequence
  derived and/or modified sequence from Influenza B hemagglutinin
MAVMAPRTLVLLLSGALALTQTWAGDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214841 - protein, 594 aa, Artificial Sequence
  derived and/or modified sequence from Influenza B hemagglutinin
MASSLYSFLLALSIVYIFVAPTHSDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214842 - protein, 589 aa, Artificial Sequence
  derived and/or modified sequence from Influenza B hemagglutinin
MTRLTVLALLAGLLASSRADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214843 - protein, 586 aa, Artificial Sequence
  derived and/or modified sequence from Influenza B hemagglutinin
MPLLLLLPLLWAGALADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214844 - protein, 589 aa, Artificial Sequence
  derived and/or modified sequence from Influenza B hemagglutinin
MIKLKFGVFFTVLLSSAYADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214845 - protein, 588 aa, Artificial Sequence
  derived and/or modified sequence from Influenza B hemagglutinin
MAFLWLLSCWALLGTTFGDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214846 - protein, 587 aa, Artificial Sequence
  derived and/or modified sequence from Influenza B hemagglutinin
MGVKVLFALICIAVAEADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214847 - protein, 587 aa, Artificial Sequence; identical to SEQ ID NO: 214846
  derived and/or modified sequence from Influenza B hemagglutinin

SEQ ID NO: 214848 - protein, 587 aa, Artificial Sequence
  derived and/or modified sequence from Influenza B hemagglutinin
MKAILVVLLYTFATANADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214849 - protein, 594 aa, Artificial Sequence
  derived and/or modified sequence from Influenza B hemagglutinin
MALWMRLLPLLALLALWGPDPAAADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214850 - protein, 590 aa, Artificial Sequence
  derived and/or modified sequence from Influenza B hemagglutinin
MYRMQLLSCIALSLALVTNSDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214851 - protein, 587 aa, Artificial Sequence
  derived and/or modified sequence from Influenza B hemagglutinin
MRAWIFFLLCLAGRALADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214852 - protein, 593 aa, Artificial Sequence
  derived and/or modified sequence from Influenza B hemagglutinin
MDAMKRGLCCVLLLCGAVFVSPSDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214853 - protein, 591 aa, Artificial Sequence
  derived and/or modified sequence from Influenza B hemagglutinin
MDAMKRGLCCVLLLCGAVFVSDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214854 - protein, 592 aa, Artificial Sequence
  derived and/or modified sequence from Influenza B hemagglutinin
MDAMKRGLCCVLLLCGAVFVSPDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214855 - protein, 597 aa, Artificial Sequence
  derived and/or modified sequence from Influenza B hemagglutinin
MGVHECPAWLWLLLSLLSLPLGLPVLGDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214856 - protein, 589 aa, Artificial Sequence
  derived and/or modified sequence from Influenza B hemagglutinin
MEFGLSWVFLVALFRGVQCDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214857 - protein, 589 aa, Artificial Sequence
  derived and/or modified sequence from Influenza B hemagglutinin
MDWTWRVFCLLAVTPGAHPDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214858 - protein, 589 aa, Artificial Sequence
  derived and/or modified sequence from Influenza B hemagglutinin
MAWSPLFLTLITHCAGSWADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214859 - protein, 591 aa, Artificial Sequence
  derived and/or modified sequence from Influenza B hemagglutinin
METDTLLLWVLLLWVPGSTGDDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214860 - protein, 596 aa, Artificial Sequence
  derived and/or modified sequence from Influenza B hemagglutinin
MKTHYSSAILPILTLFVFLSINPSHGDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214861 - protein, 591 aa, Artificial Sequence
  derived and/or modified sequence from Influenza B hemagglutinin
MGMRMMFIMFMLVVLATTVVSDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214862 - protein, 590 aa, Artificial Sequence
  derived and/or modified sequence from Influenza B hemagglutinin
MARPLCTLLLLMATLAGALADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214863 - protein, 595 aa, Artificial Sequence
  derived and/or modified sequence from Influenza B hemagglutinin
MAISGVPVLGFFIIAVLMSAQESWADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 214864 - RNA, 1767 nt, Artificial Sequence
  derived and/or modified sequence opt from Influenza B hemagglutinin
augaagugggugaccuucaucagccugcucuuccuguucuccagcgccuacuccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214865 - RNA, 1767 nt, Artificial Sequence
  derived and/or modified sequence opt from Influenza B hemagglutinin
auggacuggaccuggauccuguuccucguggccgccgcgacccgcguccacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214866 - RNA, 1785 nt, Artificial Sequence
  derived and/or modified sequence opt from Influenza B hemagglutinin
augcccaugggcagccugcagccgcucgccacccuguaccugcucgggaugcugguggccuccugccugggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214867 - RNA, 1785 nt, Artificial Sequence
  derived and/or modified sequence opt from Influenza B hemagglutinin
auggccgugauggccccgcggacccugguccuccugcugagcggcgcgcucgcccugacccagacgugggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214868 - RNA, 1788 nt, Artificial Sequence
  derived and/or modified sequence opt from Influenza B hemagglutinin
auggccgugauggccccgcggacccugguccuccugcugagcggcgcgcucgcccugacccagacgugggccggggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214869 - RNA, 1785 nt, Artificial Sequence
  derived and/or modified sequence opt from Influenza B hemagglutinin
auggccagcucccuguacagcuuccuccuggcccuguccaucguguacaucuucgucgcgcccacccacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214870 - RNA, 1770 nt, Artificial Sequence
  derived and/or modified sequence opt from Influenza B hemagglutinin
augacccgccugaccgugcucgcccugcuggccggccuccuggcgagcucccgggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214871 - RNA, 1761 nt, Artificial Sequence
  derived and/or modified sequence opt from Influenza B hemagglutinin
augccccugcuccugcugcucccgcugcugugggccggcgcccucgcggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214872 - RNA, 1770 nt, Artificial Sequence
  derived and/or modified sequence opt from Influenza B hemagglutinin
augaucaagcugaaguucggcguguucuucaccguccuccugagcuccgccuacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214873 - RNA, 1767 nt, Artificial Sequence
  derived and/or modified sequence opt from Influenza B hemagglutinin
auggccuuccuguggcuccugagcugcugggcccugcucggcaccaccuucggggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214874 - RNA, 1764 nt, Artificial Sequence
  derived and/or modified sequence opt from Influenza B hemagglutinin
augggagugaaaguucuuuuugcccuuauuuguauugcuguggccgaggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214875 - RNA, 1764 nt, Artificial Sequence
  derived and/or modified sequence opt from Influenza B hemagglutinin
augggcgugaagguccuguucgcccucaucugcaucgccguggcggaggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214876 - RNA, 1764 nt, Artificial Sequence
  derived and/or modified sequence opt from Influenza B hemagglutinin
augaaggccauccuggugguccuccuguacaccuucgccaccgcgaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214877 - RNA, 1785 nt, Artificial Sequence
  derived and/or modified sequence opt from Influenza B hemagglutinin
auggcccuguggaugcgccuccugccccugcucgcccugcuggcgcucuggggcccggaccccgccgccgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214878 - RNA, 1773 nt, Artificial Sequence
  derived and/or modified sequence opt from Influenza B hemagglutinin
auguaccggaugcagcugcucagcugcaucgcccugucgcuggcgcucgugaccaacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214879 - RNA, 1764 nt, Artificial Sequence
  derived and/or modified sequence opt from Influenza B hemagglutinin
augcgcgccuggaucuucuuccugcucugccuggccggccgggcccuggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214880 - RNA, 1782 nt, Artificial Sequence
  derived and/or modified sequence opt from Influenza B hemagglutinin
auggacgccaugaagcgcggccugugcugcgugcuccugcugugcggggccgucuucgugagccccuccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214881 - RNA, 1776 nt, Artificial Sequence
  derived and/or modified sequence opt from Influenza B hemagglutinin
auggacgccaugaagcgcggccugugcugcgugcuccugcugugcggggccgucuucgugagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214882 - RNA, 1779 nt, Artificial Sequence
  derived and/or modified sequence opt from Influenza B hemagglutinin
auggacgccaugaagcgcggccugugcugcgugcuccugcugugcggggccgucuucgugagccccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214883 - RNA, 1794 nt, Artificial Sequence
  derived and/or modified sequence opt from Influenza B hemagglutinin
augggcgugcacgagugccccgccuggcuguggcuccugcugagccuccugucccugccgcucgggcugcccguccugggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214884 - RNA, 1770 nt, Artificial Sequence
  derived and/or modified sequence opt from Influenza B hemagglutinin
auggaguucggccugagcuggguguuccucgucgcccuguuccgcggggugcagugcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214885 - RNA, 1770 nt, Artificial Sequence
  derived and/or modified sequence opt from Influenza B hemagglutinin
auggacuggaccuggcgcguguucugccugcucgccgucacccccggcgcccacccggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214886 - RNA, 1770 nt, Artificial Sequence
  derived and/or modified sequence opt from Influenza B hemagglutinin
auggccuggagcccccuguuccucacccugaucacccacugcgccggcuccugggcggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214887 - RNA, 1776 nt, Artificial Sequence
  derived and/or modified sequence opt from Influenza B hemagglutinin
auggagaccgacacccugcuccugugggugcugcuccuguggguccccggcagcacgggggacgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214888 - RNA, 1791 nt, Artificial Sequence
  derived and/or modified sequence opt from Influenza B hemagglutinin
augaagacccacuacagcuccgccauccugcccauccucacccuguucguguuccugagcaucaacccgucccacggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214889 - RNA, 1776 nt, Artificial Sequence
  derived and/or modified sequence opt from Influenza B hemagglutinin
augggcaugcgcaugauguucaucauguucaugcuggugguccucgccaccaccguggugagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214890 - RNA, 1773 nt, Artificial Sequence
  derived and/or modified sequence opt from Influenza B hemagglutinin
auggcccgcccccugugcacccuccugcugcucauggccacccuggcgggcgcccuggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214891 - RNA, 1788 nt, Artificial Sequence
  derived and/or modified sequence opt from Influenza B hemagglutinin
auggccaucagcggcgugcccguccugggguucuucaucaucgccgugcucauguccgcgcaggagagcugggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccuguga

SEQ ID NO: 214892 - RNA, 2005 nt, Artificial Sequence
  mRNA product opt Design1 from Influenza B hemagglutinin
gggagaaagcuuaccauggccgugauggccccgcggacccugguccuccugcugagcggcgcgcucgcccugacccagacgugggccggggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214893 - RNA, 2002 nt, Artificial Sequence
  mRNA product opt Design1 from Influenza B hemagglutinin
gggagaaagcuuaccauggccagcucccuguacagcuuccuccuggcccuguccaucguguacaucuucgucgcgcccacccacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214894 - RNA, 1987 nt, Artificial Sequence
  mRNA product opt Design1 from Influenza B hemagglutinin
gggagaaagcuuaccaugacccgccugaccgugcucgcccugcuggccggccuccuggcgagcucccgggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214895 - RNA, 1978 nt, Artificial Sequence
  mRNA product opt Design1 from Influenza B hemagglutinin
gggagaaagcuuaccaugccccugcuccugcugcucccgcugcugugggccggcgcccucgcggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214896 - RNA, 1987 nt, Artificial Sequence
  mRNA product opt Design1 from Influenza B hemagglutinin
gggagaaagcuuaccaugaucaagcugaaguucggcguguucuucaccguccuccugagcuccgccuacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214897 - RNA, 1984 nt, Artificial Sequence
  mRNA product opt Design1 from Influenza B hemagglutinin
gggagaaagcuuaccauggccuuccuguggcuccugagcugcugggcccugcucggcaccaccuucggggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214898 - RNA, 1981 nt, Artificial Sequence
  mRNA product opt Design1 from Influenza B hemagglutinin
gggagaaagcuuaccaugggagugaaaguucuuuuugcccuuauuuguauugcuguggccgaggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214899 - RNA, 1981 nt, Artificial Sequence
  mRNA product opt Design1 from Influenza B hemagglutinin
gggagaaagcuuaccaugggcgugaagguccuguucgcccucaucugcaucgccguggcggaggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214900 - RNA, 1981 nt, Artificial Sequence
  mRNA product opt Design1 from Influenza B hemagglutinin
gggagaaagcuuaccaugaaggccauccuggugguccuccuguacaccuucgccaccgcgaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214901 - RNA, 2002 nt, Artificial Sequence
  mRNA product opt Design1 from Influenza B hemagglutinin
gggagaaagcuuaccauggcccuguggaugcgccuccugccccugcucgcccugcuggcgcucuggggcccggaccccgccgccgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214902 - RNA, 1990 nt, Artificial Sequence
  mRNA product opt Design1 from Influenza B hemagglutinin
gggagaaagcuuaccauguaccggaugcagcugcucagcugcaucgcccugucgcuggcgcucgugaccaacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214903 - RNA, 1981 nt, Artificial Sequence
  mRNA product opt Design1 from Influenza B hemagglutinin
gggagaaagcuuaccaugcgcgccuggaucuucuuccugcucugccuggccggccgggcccuggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214904 - RNA, 1999 nt, Artificial Sequence
  mRNA product opt Design1 from Influenza B hemagglutinin
gggagaaagcuuaccauggacgccaugaagcgcggccugugcugcgugcuccugcugugcggggccgucuucgugagccccuccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214905 - RNA, 1993 nt, Artificial Sequence
  mRNA product opt Design1 from Influenza B hemagglutinin
gggagaaagcuuaccauggacgccaugaagcgcggccugugcugcgugcuccugcugugcggggccgucuucgugagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214906 - RNA, 1996 nt, Artificial Sequence
  mRNA product opt Design1 from Influenza B hemagglutinin
gggagaaagcuuaccauggacgccaugaagcgcggccugugcugcgugcuccugcugugcggggccgucuucgugagccccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214907 - RNA, 2011 nt, Artificial Sequence
  mRNA product opt Design1 from Influenza B hemagglutinin
gggagaaagcuuaccaugggcgugcacgagugccccgccuggcuguggcuccugcugagccuccugucccugccgcucgggcugcccguccugggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214908 - RNA, 1987 nt, Artificial Sequence
  mRNA product opt Design1 from Influenza B hemagglutinin
gggagaaagcuuaccauggaguucggccugagcuggguguuccucgucgcccuguuccgcggggugcagugcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214909 - RNA, 1987 nt, Artificial Sequence
  mRNA product opt Design1 from Influenza B hemagglutinin
gggagaaagcuuaccauggacuggaccuggcgcguguucugccugcucgccgucacccccggcgcccacccggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214910 - RNA, 1987 nt, Artificial Sequence
  mRNA product opt Design1 from Influenza B hemagglutinin
gggagaaagcuuaccauggccuggagcccccuguuccucacccugaucacccacugcgccggcuccugggcggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214911 - RNA, 1993 nt, Artificial Sequence
  mRNA product opt Design1 from Influenza B hemagglutinin
gggagaaagcuuaccauggagaccgacacccugcuccugugggugcugcuccuguggguccccggcagcacgggggacgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214912 - RNA, 2008 nt, Artificial Sequence
  mRNA product opt Design1 from Influenza B hemagglutinin
gggagaaagcuuaccaugaagacccacuacagcuccgccauccugcccauccucacccuguucguguuccugagcaucaacccgucccacggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214913 - RNA, 1993 nt, Artificial Sequence
  mRNA product opt Design1 from Influenza B hemagglutinin
gggagaaagcuuaccaugggcaugcgcaugauguucaucauguucaugcuggugguccucgccaccaccguggugagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214914 - RNA, 1990 nt, Artificial Sequence
  mRNA product opt Design1 from Influenza B hemagglutinin
gggagaaagcuuaccauggcccgcccccugugcacccuccugcugcucauggccacccuggcgggcgcccuggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214915 - RNA, 2005 nt, Artificial Sequence
  mRNA product opt Design1 from Influenza B hemagglutinin
gggagaaagcuuaccauggccaucagcggcgugcccguccugggguucuucaucaucgccgugcucauguccgcgcaggagagcugggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214916 - RNA, 2170 nt, Artificial Sequence
  mRNA product opt Design2 from Influenza B hemagglutinin
ggggcgcugccuacggagguggcagccaucuccuucucggcaucaagcuuaccauggccgugauggccccgcggacccugguccuccugcugagcggcgcgcucgcccugacccagacgugggccggggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214917 - RNA, 2167 nt, Artificial Sequence
  mRNA product opt Design2 from Influenza B hemagglutinin
ggggcgcugccuacggagguggcagccaucuccuucucggcaucaagcuuaccauggccagcucccuguacagcuuccuccuggcccuguccaucguguacaucuucgucgcgcccacccacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214918 - RNA, 2152 nt, Artificial Sequence
  mRNA product opt Design2 from Influenza B hemagglutinin
ggggcgcugccuacggagguggcagccaucuccuucucggcaucaagcuuaccaugacccgccugaccgugcucgcccugcuggccggccuccuggcgagcucccgggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214919 - RNA, 2143 nt, Artificial Sequence
  mRNA product opt Design2 from Influenza B hemagglutinin
ggggcgcugccuacggagguggcagccaucuccuucucggcaucaagcuuaccaugccccugcuccugcugcucccgcugcugugggccggcgcccucgcggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214920 - RNA, 2152 nt, Artificial Sequence
  mRNA product opt Design2 from Influenza B hemagglutinin
ggggcgcugccuacggagguggcagccaucuccuucucggcaucaagcuuaccaugaucaagcugaaguucggcguguucuucaccguccuccugagcuccgccuacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214921 - RNA, 2149 nt, Artificial Sequence
  mRNA product opt Design2 from Influenza B hemagglutinin
ggggcgcugccuacggagguggcagccaucuccuucucggcaucaagcuuaccauggccuuccuguggcuccugagcugcugggcccugcucggcaccaccuucggggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214922 - RNA, 2146 nt, Artificial Sequence
  mRNA product opt Design2 from Influenza B hemagglutinin
ggggcgcugccuacggagguggcagccaucuccuucucggcaucaagcuuaccaugggagugaaaguucuuuuugcccuuauuuguauugcuguggccgaggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214923 - RNA, 2146 nt, Artificial Sequence
  mRNA product opt Design2 from Influenza B hemagglutinin
ggggcgcugccuacggagguggcagccaucuccuucucggcaucaagcuuaccaugggcgugaagguccuguucgcccucaucugcaucgccguggcggaggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214924 - RNA, 2146 nt, Artificial Sequence
  mRNA product opt Design2 from Influenza B hemagglutinin
ggggcgcugccuacggagguggcagccaucuccuucucggcaucaagcuuaccaugaaggccauccuggugguccuccuguacaccuucgccaccgcgaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214925 - RNA, 2167 nt, Artificial Sequence
  mRNA product opt Design2 from Influenza B hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214926 - RNA, 2155 nt, Artificial Sequence
  mRNA product opt Design2 from Influenza B hemagglutinin
ggggcgcugccuacggagguggcagccaucuccuucucggcaucaagcuuaccauguaccggaugcagcugcucagcugcaucgcccugucgcuggcgcucgugaccaacagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214927 - RNA, 2146 nt, Artificial Sequence
  mRNA product opt Design2 from Influenza B hemagglutinin
ggggcgcugccuacggagguggcagccaucuccuucucggcaucaagcuuaccaugcgcgccuggaucuucuuccugcucugccuggccggccgggcccuggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214928 - RNA, 2164 nt, Artificial Sequence
  mRNA product opt Design2 from Influenza B hemagglutinin
ggggcgcugccuacggagguggcagccaucuccuucucggcaucaagcuuaccauggacgccaugaagcgcggccugugcugcgugcuccugcugugcggggccgucuucgugagccccuccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214929 - RNA, 2158 nt, Artificial Sequence
  mRNA product opt Design2 from Influenza B hemagglutinin
ggggcgcugccuacggagguggcagccaucuccuucucggcaucaagcuuaccauggacgccaugaagcgcggccugugcugcgugcuccugcugugcggggccgucuucgugagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214930 - RNA, 2161 nt, Artificial Sequence
  mRNA product opt Design2 from Influenza B hemagglutinin
ggggcgcugccuacggagguggcagccaucuccuucucggcaucaagcuuaccauggacgccaugaagcgcggccugugcugcgugcuccugcugugcggggccgucuucgugagccccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214931 - RNA, 2176 nt, Artificial Sequence
  mRNA product opt Design2 from Influenza B hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214932 - RNA, 2152 nt, Artificial Sequence
  mRNA product opt Design2 from Influenza B hemagglutinin
ggggcgcugccuacggagguggcagccaucuccuucucggcaucaagcuuaccauggaguucggccugagcuggguguuccucgucgcccuguuccgcggggugcagugcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214933 - RNA, 2152 nt, Artificial Sequence
  mRNA product opt Design2 from Influenza B hemagglutinin
ggggcgcugccuacggagguggcagccaucuccuucucggcaucaagcuuaccauggacuggaccuggcgcguguucugccugcucgccgucacccccggcgcccacccggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214934 - RNA, 2152 nt, Artificial Sequence
  mRNA product opt Design2 from Influenza B hemagglutinin
ggggcgcugccuacggagguggcagccaucuccuucucggcaucaagcuuaccauggccuggagcccccuguuccucacccugaucacccacugcgccggcuccugggcggaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214935 - RNA, 2158 nt, Artificial Sequence
  mRNA product opt Design2 from Influenza B hemagglutinin
ggggcgcugccuacggagguggcagccaucuccuucucggcaucaagcuuaccauggagaccgacacccugcuccugugggugcugcuccuguggguccccggcagcacgggggacgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214936 - RNA, 2173 nt, Artificial Sequence
  mRNA product opt Design2 from Influenza B hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214937 - RNA, 2158 nt, Artificial Sequence
  mRNA product opt Design2 from Influenza B hemagglutinin
ggggcgcugccuacggagguggcagccaucuccuucucggcaucaagcuuaccaugggcaugcgcaugauguucaucauguucaugcuggugguccucgccaccaccguggugagcgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214938 - RNA, 2155 nt, Artificial Sequence
  mRNA product opt Design2 from Influenza B hemagglutinin
ggggcgcugccuacggagguggcagccaucuccuucucggcaucaagcuuaccauggcccgcccccugugcacccuccugcugcucauggccacccuggcgggcgcccuggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214939 - RNA, 2170 nt, Artificial Sequence
  mRNA product opt Design2 from Influenza B hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214940 - protein, 587 aa, Artificial Sequence
  derived and/or modified sequence from Influenza B hemagglutinin
MKWVTFISLLFLFSSAYSDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214941 - protein, 587 aa, Artificial Sequence
  derived and/or modified sequence from Influenza B hemagglutinin
MDWTWILFLVAAATRVHSDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214942 - protein, 593 aa, Artificial Sequence
  derived and/or modified sequence from Influenza B hemagglutinin
MPMGSLQPLATLYLLGMLVASCLGDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214943 - protein, 593 aa, Artificial Sequence
  derived and/or modified sequence from Influenza B hemagglutinin
MAVMAPRTLVLLLSGALALTQTWADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214944 - protein, 594 aa, Artificial Sequence
  derived and/or modified sequence from Influenza B hemagglutinin
MAVMAPRTLVLLLSGALALTQTWAGDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214945 - protein, 593 aa, Artificial Sequence
  derived and/or modified sequence from Influenza B hemagglutinin
MASSLYSFLLALSIVYIFVAPTHSDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214946 - protein, 588 aa, Artificial Sequence
  derived and/or modified sequence from Influenza B hemagglutinin
MTRLTVLALLAGLLASSRADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214947 - protein, 585 aa, Artificial Sequence
  derived and/or modified sequence from Influenza B hemagglutinin
MPLLLLLPLLWAGALADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214948 - protein, 588 aa, Artificial Sequence
  derived and/or modified sequence from Influenza B hemagglutinin
MIKLKFGVFFTVLLSSAYADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214949 - protein, 587 aa, Artificial Sequence
  derived and/or modified sequence from Influenza B hemagglutinin
MAFLWLLSCWALLGTTFGDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214950 - protein, 586 aa, Artificial Sequence
  derived and/or modified sequence from Influenza B hemagglutinin
MGVKVLFALICIAVAEADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214951 - protein, 586 aa, Artificial Sequence; identical to SEQ ID NO: 214950
  derived and/or modified sequence from Influenza B hemagglutinin

SEQ ID NO: 214952 - protein, 586 aa, Artificial Sequence
  derived and/or modified sequence from Influenza B hemagglutinin
MKAILVVLLYTFATANADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214953 - protein, 593 aa, Artificial Sequence
  derived and/or modified sequence from Influenza B hemagglutinin
MALWMRLLPLLALLALWGPDPAAADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214954 - protein, 589 aa, Artificial Sequence
  derived and/or modified sequence from Influenza B hemagglutinin
MYRMQLLSCIALSLALVTNSDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214955 - protein, 586 aa, Artificial Sequence
  derived and/or modified sequence from Influenza B hemagglutinin
MRAWIFFLLCLAGRALADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214956 - protein, 592 aa, Artificial Sequence
  derived and/or modified sequence from Influenza B hemagglutinin
MDAMKRGLCCVLLLCGAVFVSPSDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214957 - protein, 590 aa, Artificial Sequence
  derived and/or modified sequence from Influenza B hemagglutinin
MDAMKRGLCCVLLLCGAVFVSDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214958 - protein, 591 aa, Artificial Sequence
  derived and/or modified sequence from Influenza B hemagglutinin
MDAMKRGLCCVLLLCGAVFVSPDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214959 - protein, 596 aa, Artificial Sequence
  derived and/or modified sequence from Influenza B hemagglutinin
MGVHECPAWLWLLLSLLSLPLGLPVLGDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214960 - protein, 588 aa, Artificial Sequence
  derived and/or modified sequence from Influenza B hemagglutinin
MEFGLSWVFLVALFRGVQCDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214961 - protein, 588 aa, Artificial Sequence
  derived and/or modified sequence from Influenza B hemagglutinin
MDWTWRVFCLLAVTPGAHPDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214962 - protein, 588 aa, Artificial Sequence
  derived and/or modified sequence from Influenza B hemagglutinin
MAWSPLFLTLITHCAGSWADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214963 - protein, 590 aa, Artificial Sequence
  derived and/or modified sequence from Influenza B hemagglutinin
METDTLLLWVLLLWVPGSTGDDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214964 - protein, 595 aa, Artificial Sequence
  derived and/or modified sequence from Influenza B hemagglutinin
MKTHYSSAILPILTLFVFLSINPSHGDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214965 - protein, 590 aa, Artificial Sequence
  derived and/or modified sequence from Influenza B hemagglutinin
MGMRMMFIMFMLVVLATTVVSDRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214966 - protein, 589 aa, Artificial Sequence
  derived and/or modified sequence from Influenza B hemagglutinin
MARPLCTLLLLMATLAGALADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214967 - protein, 594 aa, Artificial Sequence
  derived and/or modified sequence from Influenza B hemagglutinin
MAISGVPVLGFFIIAVLMSAQESWADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 214968 - RNA, 1764 nt, Artificial Sequence
  derived and/or modified sequence opt from Influenza B hemagglutinin
augaagugggugaccuucaucagccugcucuuccuguucuccagcgccuacuccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214969 - RNA, 1764 nt, Artificial Sequence
  derived and/or modified sequence opt from Influenza B hemagglutinin
auggacuggaccuggauccuguuccucguggccgccgcgacccgcguccacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214970 - RNA, 1782 nt, Artificial Sequence
  derived and/or modified sequence opt from Influenza B hemagglutinin
augcccaugggcagccugcagccgcucgccacccuguaccugcucgggaugcugguggccuccugccugggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214971 - RNA, 1782 nt, Artificial Sequence
  derived and/or modified sequence opt from Influenza B hemagglutinin
auggccgugauggccccgcggacccugguccuccugcugagcggcgcgcucgcccugacccagacgugggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214972 - RNA, 1785 nt, Artificial Sequence
  derived and/or modified sequence opt from Influenza B hemagglutinin
auggccgugauggccccgcggacccugguccuccugcugagcggcgcgcucgcccugacccagacgugggccggggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214973 - RNA, 1782 nt, Artificial Sequence
  derived and/or modified sequence opt from Influenza B hemagglutinin
auggccagcucccuguacagcuuccuccuggcccuguccaucguguacaucuucgucgcgcccacccacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214974 - RNA, 1767 nt, Artificial Sequence
  derived and/or modified sequence opt from Influenza B hemagglutinin
augacccgccugaccgugcucgcccugcuggccggccuccuggcgagcucccgggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214975 - RNA, 1758 nt, Artificial Sequence
  derived and/or modified sequence opt from Influenza B hemagglutinin
augccccugcuccugcugcucccgcugcugugggccggcgcccucgcggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214976 - RNA, 1767 nt, Artificial Sequence
  derived and/or modified sequence opt from Influenza B hemagglutinin
augaucaagcugaaguucggcguguucuucaccguccuccugagcuccgccuacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214977 - RNA, 1764 nt, Artificial Sequence
  derived and/or modified sequence opt from Influenza B hemagglutinin
auggccuuccuguggcuccugagcugcugggcccugcucggcaccaccuucggggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214978 - RNA, 1761 nt, Artificial Sequence
  derived and/or modified sequence opt from Influenza B hemagglutinin
augggagugaaaguucuuuuugcccuuauuuguauugcuguggccgaggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214979 - RNA, 1761 nt, Artificial Sequence
  derived and/or modified sequence opt from Influenza B hemagglutinin
augggcgugaagguccuguucgcccucaucugcaucgccguggcggaggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214980 - RNA, 1761 nt, Artificial Sequence
  derived and/or modified sequence opt from Influenza B hemagglutinin
augaaggccauccuggugguccuccuguacaccuucgccaccgcgaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214981 - RNA, 1782 nt, Artificial Sequence
  derived and/or modified sequence opt from Influenza B hemagglutinin
auggcccuguggaugcgccuccugccccugcucgcccugcuggcgcucuggggcccggaccccgccgccgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214982 - RNA, 1770 nt, Artificial Sequence
  derived and/or modified sequence opt from Influenza B hemagglutinin
auguaccggaugcagcugcucagcugcaucgcccugucgcuggcgcucgugaccaacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214983 - RNA, 1761 nt, Artificial Sequence
  derived and/or modified sequence opt from Influenza B hemagglutinin
augcgcgccuggaucuucuuccugcucugccuggccggccgggcccuggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214984 - RNA, 1779 nt, Artificial Sequence
  derived and/or modified sequence opt from Influenza B hemagglutinin
auggacgccaugaagcgcggccugugcugcgugcuccugcugugcggggccgucuucgugagccccuccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214985 - RNA, 1773 nt, Artificial Sequence
  derived and/or modified sequence opt from Influenza B hemagglutinin
auggacgccaugaagcgcggccugugcugcgugcuccugcugugcggggccgucuucgugagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214986 - RNA, 1776 nt, Artificial Sequence
  derived and/or modified sequence opt from Influenza B hemagglutinin
auggacgccaugaagcgcggccugugcugcgugcuccugcugugcggggccgucuucgugagccccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214987 - RNA, 1791 nt, Artificial Sequence
  derived and/or modified sequence opt from Influenza B hemagglutinin
augggcgugcacgagugccccgccuggcuguggcuccugcugagccuccugucccugccgcucgggcugcccguccugggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214988 - RNA, 1767 nt, Artificial Sequence
  derived and/or modified sequence opt from Influenza B hemagglutinin
auggaguucggccugagcuggguguuccucgucgcccuguuccgcggggugcagugcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214989 - RNA, 1767 nt, Artificial Sequence
  derived and/or modified sequence opt from Influenza B hemagglutinin
auggacuggaccuggcgcguguucugccugcucgccgucacccccggcgcccacccggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214990 - RNA, 1767 nt, Artificial Sequence
  derived and/or modified sequence opt from Influenza B hemagglutinin
auggccuggagcccccuguuccucacccugaucacccacugcgccggcuccugggcggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214991 - RNA, 1773 nt, Artificial Sequence
  derived and/or modified sequence opt from Influenza B hemagglutinin
auggagaccgacacccugcuccugugggugcugcuccuguggguccccggcagcacgggggacgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214992 - RNA, 1788 nt, Artificial Sequence
  derived and/or modified sequence opt from Influenza B hemagglutinin
augaagacccacuacagcuccgccauccugcccauccucacccuguucguguuccugagcaucaacccgucccacggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214993 - RNA, 1773 nt, Artificial Sequence
  derived and/or modified sequence opt from Influenza B hemagglutinin
augggcaugcgcaugauguucaucauguucaugcuggugguccucgccaccaccguggugagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214994 - RNA, 1770 nt, Artificial Sequence
  derived and/or modified sequence opt from Influenza B hemagglutinin
auggcccgcccccugugcacccuccugcugcucauggccacccuggcgggcgcccuggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214995 - RNA, 1785 nt, Artificial Sequence
  derived and/or modified sequence opt from Influenza B hemagglutinin
auggccaucagcggcgugcccguccugggguucuucaucaucgccgugcucauguccgcgcaggagagcugggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 214996 - RNA, 2002 nt, Artificial Sequence
  mRNA product opt Design1 from Influenza B hemagglutinin
gggagaaagcuuaccauggccgugauggccccgcggacccugguccuccugcugagcggcgcgcucgcccugacccagacgugggccggggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214997 - RNA, 1999 nt, Artificial Sequence
  mRNA product opt Design1 from Influenza B hemagglutinin
gggagaaagcuuaccauggccagcucccuguacagcuuccuccuggcccuguccaucguguacaucuucgucgcgcccacccacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214998 - RNA, 1984 nt, Artificial Sequence
  mRNA product opt Design1 from Influenza B hemagglutinin
gggagaaagcuuaccaugacccgccugaccgugcucgcccugcuggccggccuccuggcgagcucccgggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 214999 - RNA, 1975 nt, Artificial Sequence
  mRNA product opt Design1 from Influenza B hemagglutinin
gggagaaagcuuaccaugccccugcuccugcugcucccgcugcugugggccggcgcccucgcggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215000 - RNA, 1984 nt, Artificial Sequence
  mRNA product opt Design1 from Influenza B hemagglutinin
gggagaaagcuuaccaugaucaagcugaaguucggcguguucuucaccguccuccugagcuccgccuacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215001 - RNA, 1981 nt, Artificial Sequence
  mRNA product opt Design1 from Influenza B hemagglutinin
gggagaaagcuuaccauggccuuccuguggcuccugagcugcugggcccugcucggcaccaccuucggggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215002 - RNA, 1978 nt, Artificial Sequence
  mRNA product opt Design1 from Influenza B hemagglutinin
gggagaaagcuuaccaugggagugaaaguucuuuuugcccuuauuuguauugcuguggccgaggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215003 - RNA, 1978 nt, Artificial Sequence
  mRNA product opt Design1 from Influenza B hemagglutinin
gggagaaagcuuaccaugggcgugaagguccuguucgcccucaucugcaucgccguggcggaggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215004 - RNA, 1978 nt, Artificial Sequence
  mRNA product opt Design1 from Influenza B hemagglutinin
gggagaaagcuuaccaugaaggccauccuggugguccuccuguacaccuucgccaccgcgaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215005 - RNA, 1999 nt, Artificial Sequence
  mRNA product opt Design1 from Influenza B hemagglutinin
gggagaaagcuuaccauggcccuguggaugcgccuccugccccugcucgcccugcuggcgcucuggggcccggaccccgccgccgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215006 - RNA, 1987 nt, Artificial Sequence
  mRNA product opt Design1 from Influenza B hemagglutinin
gggagaaagcuuaccauguaccggaugcagcugcucagcugcaucgcccugucgcuggcgcucgugaccaacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215007 - RNA, 1978 nt, Artificial Sequence
  mRNA product opt Design1 from Influenza B hemagglutinin
gggagaaagcuuaccaugcgcgccuggaucuucuuccugcucugccuggccggccgggcccuggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215008 - RNA, 1996 nt, Artificial Sequence
  mRNA product opt Design1 from Influenza B hemagglutinin
gggagaaagcuuaccauggacgccaugaagcgcggccugugcugcgugcuccugcugugcggggccgucuucgugagccccuccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215009 - RNA, 1990 nt, Artificial Sequence
  mRNA product opt Design1 from Influenza B hemagglutinin
gggagaaagcuuaccauggacgccaugaagcgcggccugugcugcgugcuccugcugugcggggccgucuucgugagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215010 - RNA, 1993 nt, Artificial Sequence
  mRNA product opt Design1 from Influenza B hemagglutinin
gggagaaagcuuaccauggacgccaugaagcgcggccugugcugcgugcuccugcugugcggggccgucuucgugagccccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215011 - RNA, 2008 nt, Artificial Sequence
  mRNA product opt Design1 from Influenza B hemagglutinin
gggagaaagcuuaccaugggcgugcacgagugccccgccuggcuguggcuccugcugagccuccugucccugccgcucgggcugcccguccugggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215012 - RNA, 1984 nt, Artificial Sequence
  mRNA product opt Design1 from Influenza B hemagglutinin
gggagaaagcuuaccauggaguucggccugagcuggguguuccucgucgcccuguuccgcggggugcagugcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215013 - RNA, 1984 nt, Artificial Sequence
  mRNA product opt Design1 from Influenza B hemagglutinin
gggagaaagcuuaccauggacuggaccuggcgcguguucugccugcucgccgucacccccggcgcccacccggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215014 - RNA, 1984 nt, Artificial Sequence
  mRNA product opt Design1 from Influenza B hemagglutinin
gggagaaagcuuaccauggccuggagcccccuguuccucacccugaucacccacugcgccggcuccugggcggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215015 - RNA, 1990 nt, Artificial Sequence
  mRNA product opt Design1 from Influenza B hemagglutinin
gggagaaagcuuaccauggagaccgacacccugcuccugugggugcugcuccuguggguccccggcagcacgggggacgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215016 - RNA, 2005 nt, Artificial Sequence
  mRNA product opt Design1 from Influenza B hemagglutinin
gggagaaagcuuaccaugaagacccacuacagcuccgccauccugcccauccucacccuguucguguuccugagcaucaacccgucccacggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215017 - RNA, 1990 nt, Artificial Sequence
  mRNA product opt Design1 from Influenza B hemagglutinin
gggagaaagcuuaccaugggcaugcgcaugauguucaucauguucaugcuggugguccucgccaccaccguggugagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215018 - RNA, 1987 nt, Artificial Sequence
  mRNA product opt Design1 from Influenza B hemagglutinin
gggagaaagcuuaccauggcccgcccccugugcacccuccugcugcucauggccacccuggcgggcgcccuggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215019 - RNA, 2002 nt, Artificial Sequence
  mRNA product opt Design1 from Influenza B hemagglutinin
gggagaaagcuuaccauggccaucagcggcgugcccguccugggguucuucaucaucgccgugcucauguccgcgcaggagagcugggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215020 - RNA, 2167 nt, Artificial Sequence
  mRNA product opt Design2 from Influenza B hemagglutinin
ggggcgcugccuacggagguggcagccaucuccuucucggcaucaagcuuaccauggccgugauggccccgcggacccugguccuccugcugagcggcgcgcucgcccugacccagacgugggccggggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215021 - RNA, 2164 nt, Artificial Sequence
  mRNA product opt Design2 from Influenza B hemagglutinin
ggggcgcugccuacggagguggcagccaucuccuucucggcaucaagcuuaccauggccagcucccuguacagcuuccuccuggcccuguccaucguguacaucuucgucgcgcccacccacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215022 - RNA, 2149 nt, Artificial Sequence
  mRNA product opt Design2 from Influenza B hemagglutinin
ggggcgcugccuacggagguggcagccaucuccuucucggcaucaagcuuaccaugacccgccugaccgugcucgcccugcuggccggccuccuggcgagcucccgggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215023 - RNA, 2140 nt, Artificial Sequence
  mRNA product opt Design2 from Influenza B hemagglutinin
ggggcgcugccuacggagguggcagccaucuccuucucggcaucaagcuuaccaugccccugcuccugcugcucccgcugcugugggccggcgcccucgcggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215024 - RNA, 2149 nt, Artificial Sequence
  mRNA product opt Design2 from Influenza B hemagglutinin
ggggcgcugccuacggagguggcagccaucuccuucucggcaucaagcuuaccaugaucaagcugaaguucggcguguucuucaccguccuccugagcuccgccuacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215025 - RNA, 2146 nt, Artificial Sequence
  mRNA product opt Design2 from Influenza B hemagglutinin
ggggcgcugccuacggagguggcagccaucuccuucucggcaucaagcuuaccauggccuuccuguggcuccugagcugcugggcccugcucggcaccaccuucggggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215026 - RNA, 2143 nt, Artificial Sequence
  mRNA product opt Design2 from Influenza B hemagglutinin
ggggcgcugccuacggagguggcagccaucuccuucucggcaucaagcuuaccaugggagugaaaguucuuuuugcccuuauuuguauugcuguggccgaggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215027 - RNA, 2143 nt, Artificial Sequence
  mRNA product opt Design2 from Influenza B hemagglutinin
ggggcgcugccuacggagguggcagccaucuccuucucggcaucaagcuuaccaugggcgugaagguccuguucgcccucaucugcaucgccguggcggaggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215028 - RNA, 2143 nt, Artificial Sequence
  mRNA product opt Design2 from Influenza B hemagglutinin
ggggcgcugccuacggagguggcagccaucuccuucucggcaucaagcuuaccaugaaggccauccuggugguccuccuguacaccuucgccaccgcgaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215029 - RNA, 2164 nt, Artificial Sequence
  mRNA product opt Design2 from Influenza B hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215030 - RNA, 2152 nt, Artificial Sequence
  mRNA product opt Design2 from Influenza B hemagglutinin
ggggcgcugccuacggagguggcagccaucuccuucucggcaucaagcuuaccauguaccggaugcagcugcucagcugcaucgcccugucgcuggcgcucgugaccaacagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215031 - RNA, 2143 nt, Artificial Sequence
  mRNA product opt Design2 from Influenza B hemagglutinin
ggggcgcugccuacggagguggcagccaucuccuucucggcaucaagcuuaccaugcgcgccuggaucuucuuccugcucugccuggccggccgggcccuggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215032 - RNA, 2161 nt, Artificial Sequence
  mRNA product opt Design2 from Influenza B hemagglutinin
ggggcgcugccuacggagguggcagccaucuccuucucggcaucaagcuuaccauggacgccaugaagcgcggccugugcugcgugcuccugcugugcggggccgucuucgugagccccuccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215033 - RNA, 2155 nt, Artificial Sequence
  mRNA product opt Design2 from Influenza B hemagglutinin
ggggcgcugccuacggagguggcagccaucuccuucucggcaucaagcuuaccauggacgccaugaagcgcggccugugcugcgugcuccugcugugcggggccgucuucgugagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215034 - RNA, 2158 nt, Artificial Sequence
  mRNA product opt Design2 from Influenza B hemagglutinin
ggggcgcugccuacggagguggcagccaucuccuucucggcaucaagcuuaccauggacgccaugaagcgcggccugugcugcgugcuccugcugugcggggccgucuucgugagccccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215035 - RNA, 2173 nt, Artificial Sequence
  mRNA product opt Design2 from Influenza B hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215036 - RNA, 2149 nt, Artificial Sequence
  mRNA product opt Design2 from Influenza B hemagglutinin
ggggcgcugccuacggagguggcagccaucuccuucucggcaucaagcuuaccauggaguucggccugagcuggguguuccucgucgcccuguuccgcggggugcagugcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215037 - RNA, 2149 nt, Artificial Sequence
  mRNA product opt Design2 from Influenza B hemagglutinin
ggggcgcugccuacggagguggcagccaucuccuucucggcaucaagcuuaccauggacuggaccuggcgcguguucugccugcucgccgucacccccggcgcccacccggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215038 - RNA, 2149 nt, Artificial Sequence
  mRNA product opt Design2 from Influenza B hemagglutinin
ggggcgcugccuacggagguggcagccaucuccuucucggcaucaagcuuaccauggccuggagcccccuguuccucacccugaucacccacugcgccggcuccugggcggaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215039 - RNA, 2155 nt, Artificial Sequence
  mRNA product opt Design2 from Influenza B hemagglutinin
ggggcgcugccuacggagguggcagccaucuccuucucggcaucaagcuuaccauggagaccgacacccugcuccugugggugcugcuccuguggguccccggcagcacgggggacgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215040 - RNA, 2170 nt, Artificial Sequence
  mRNA product opt Design2 from Influenza B hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215041 - RNA, 2155 nt, Artificial Sequence
  mRNA product opt Design2 from Influenza B hemagglutinin
ggggcgcugccuacggagguggcagccaucuccuucucggcaucaagcuuaccaugggcaugcgcaugauguucaucauguucaugcuggugguccucgccaccaccguggugagcgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215042 - RNA, 2152 nt, Artificial Sequence
  mRNA product opt Design2 from Influenza B hemagglutinin
ggggcgcugccuacggagguggcagccaucuccuucucggcaucaagcuuaccauggcccgcccccugugcacccuccugcugcucauggccacccuggcgggcgcccuggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215043 - RNA, 2167 nt, Artificial Sequence
  mRNA product opt Design2 from Influenza B hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215044 - protein, 567 aa, Artificial Sequence
  Influenza A H5N8 hemagglutinin
MENMVLLLAIVSLVKSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215045 - RNA, 1704 nt, Artificial Sequence
  Influenza A H5N8 hemagglutinin
auggagaacauggugcuucuucuugcaauaguuagccuuguuaaaagugaucagauuugcauugguuaccaugcaaacaacucgacagagcaaguugacacgauaauggaaaagaacgucacuguuacacaugcccaagacauacuggaaaaaacacacaacgggaagcucugcgaucuaaauggggugaagccucugauuuuaaaggauuguaguguagcuggauggcuccucggaaacccaaugugcgacgaauucaucagagugccggaauggucuuacauaguggagagggcuaacccagcuaaugaccucuguuacccagggagccucaaugacuaugaagaacugaaacaccuguugagcagaauaaaucauuuugagaagauucagaucauccccaagaguucuuggcccaaucaugaaacaucauuagggguaagcgcagcuuguccauaucagggaacgcccuccuuuuucagaaaugugguauggcuuaucaaaaagaacgaugcauacccaacaauaaagauaagcuacaauaauaccaaucgggaagaucucuugauacugugggggauucaucauuccaacaaugcagaagagcagacaaaucucuacaaaaacccaaccaccuauauuucaguuggaacaucaacauuaaaccagagauugguaccaaaaauagcuacuagaucccaaguaaacgggcaacguggaagaauggacuucuucuggacaauuuuaaaaccgaaugaugcaauccacuucgagaguaauggaaauuucauugcuccagaauaugcauacaaaauugucaagaaaggggacucaacaauuaugaaaaguggaguggaauauggccacugcaacaccaaaugucaaaccccaguaggagcgauaaacucuaguaugccguuccacaauauacauccucucaccaucggggaaugccccaaauacgugaagucaaacaaguugguccuugcgacugggcucagaaauaguccucuaagagaaaagagaagaaaaagagggcuguuuggggcuauagcagguuuuauagagggaggauggcagggaaugguugaugguugguauggguaccaccauagcaaugagcaggggaguggguacgcugcagacaaagaauccacccaaaaggcaauagauggaguuaccaauaaggucaacucgaucauugacaaaaugaacacucaauuugaggcaguuggaagggaguuuaauaacuuagaaaggaggauagagaauuugaacaagaaaauggaagacggauuccuagaugucuggaccuauaaugcugaacuucuaguucucauggaaaacgagaggacucuagauuuccaugacucaaaugucaagaaccuuuacgacaaagucagacugcagcuuagggauaaugcaagggagcuggguaacgguuguuucgaguucuaucacaaaugugauaaugaaugcauggaaagugugagaaaugggacguaugacuacccucaguauucagaagaagcaagauuaaaaagagaagaaauaggcggagugaaauuagaaucaauaggaacuuaccaaauacugucaauuuauucaacaguggcgaguucccuagcacuggcaaucaugguggcuggucuaucuuuauggaugugcuccaaugggucguuacagugcagaauuugcauuuaa

SEQ ID NO: 215046 - RNA, 1704 nt, Artificial Sequence
  derived and/or modified sequence opt from Influenza A H5N8 hemagglutinin
auggagaacauggugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215047 - RNA, 1921 nt, Artificial Sequence
  mRNA product opt Design1 from Influenza A H5N8 hemagglutinin
gggagaaagcuuaccauggagaacauggugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215048 - RNA, 2086 nt, Artificial Sequence
  R5819 mRNA product opt Design2 from Influenza A H5N8 hemagglutinin
ggggcgcugccuacggagguggcagccaucuccuucucggcaucaagcuuaccauggagaacauggugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215049 - protein, 569 aa, Artificial Sequence
  derived and/or modified sequence from Influenza A H5N8 hemagglutinin
MKWVTFISLLFLFSSAYSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215050 - protein, 569 aa, Artificial Sequence
  derived and/or modified sequence from Influenza A H5N8 hemagglutinin
MDWTWILFLVAAATRVHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215051 - protein, 575 aa, Artificial Sequence
  derived and/or modified sequence from Influenza A H5N8 hemagglutinin
MPMGSLQPLATLYLLGMLVASCLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215052 - protein, 575 aa, Artificial Sequence
  derived and/or modified sequence from Influenza A H5N8 hemagglutinin
MAVMAPRTLVLLLSGALALTQTWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215053 - protein, 576 aa, Artificial Sequence
  derived and/or modified sequence from Influenza A H5N8 hemagglutinin
MAVMAPRTLVLLLSGALALTQTWAGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215054 - protein, 575 aa, Artificial Sequence
  derived and/or modified sequence from Influenza A H5N8 hemagglutinin
MASSLYSFLLALSIVYIFVAPTHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215055 - protein, 570 aa, Artificial Sequence
  derived and/or modified sequence from Influenza A H5N8 hemagglutinin
MTRLTVLALLAGLLASSRADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215056 - protein, 567 aa, Artificial Sequence
  derived and/or modified sequence from Influenza A H5N8 hemagglutinin
MPLLLLLPLLWAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215057 - protein, 570 aa, Artificial Sequence
  derived and/or modified sequence from Influenza A H5N8 hemagglutinin
MIKLKFGVFFTVLLSSAYADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215058 - protein, 569 aa, Artificial Sequence
  derived and/or modified sequence from Influenza A H5N8 hemagglutinin
MAFLWLLSCWALLGTTFGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215059 - protein, 568 aa, Artificial Sequence
  derived and/or modified sequence from Influenza A H5N8 hemagglutinin
MGVKVLFALICIAVAEADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215060 - protein, 568 aa, Artificial Sequence; identical to SEQ ID NO: 215059
  derived and/or modified sequence from Influenza A H5N8 hemagglutinin

SEQ ID NO: 215061 - protein, 568 aa, Artificial Sequence
  derived and/or modified sequence from Influenza A H5N8 hemagglutinin
MKAILVVLLYTFATANADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215062 - protein, 575 aa, Artificial Sequence
  derived and/or modified sequence from Influenza A H5N8 hemagglutinin
MALWMRLLPLLALLALWGPDPAAADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215063 - protein, 571 aa, Artificial Sequence
  derived and/or modified sequence from Influenza A H5N8 hemagglutinin
MYRMQLLSCIALSLALVTNSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215064 - protein, 568 aa, Artificial Sequence
  derived and/or modified sequence from Influenza A H5N8 hemagglutinin
MRAWIFFLLCLAGRALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215065 - protein, 574 aa, Artificial Sequence
  derived and/or modified sequence from Influenza A H5N8 hemagglutinin
MDAMKRGLCCVLLLCGAVFVSPSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215066 - protein, 572 aa, Artificial Sequence
  derived and/or modified sequence from Influenza A H5N8 hemagglutinin
MDAMKRGLCCVLLLCGAVFVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215067 - protein, 573 aa, Artificial Sequence
  derived and/or modified sequence from Influenza A H5N8 hemagglutinin
MDAMKRGLCCVLLLCGAVFVSPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215068 - protein, 578 aa, Artificial Sequence
  derived and/or modified sequence from Influenza A H5N8 hemagglutinin
MGVHECPAWLWLLLSLLSLPLGLPVLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215069 - protein, 570 aa, Artificial Sequence
  derived and/or modified sequence from Influenza A H5N8 hemagglutinin
MEFGLSWVFLVALFRGVQCDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215070 - protein, 570 aa, Artificial Sequence
  derived and/or modified sequence from Influenza A H5N8 hemagglutinin
MDWTWRVFCLLAVTPGAHPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215071 - protein, 570 aa, Artificial Sequence
  derived and/or modified sequence from Influenza A H5N8 hemagglutinin
MAWSPLFLTLITHCAGSWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215072 - protein, 572 aa, Artificial Sequence
  derived and/or modified sequence from Influenza A H5N8 hemagglutinin
METDTLLLWVLLLWVPGSTGDDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215073 - protein, 577 aa, Artificial Sequence
  derived and/or modified sequence from Influenza A H5N8 hemagglutinin
MKTHYSSAILPILTLFVFLSINPSHGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215074 - protein, 572 aa, Artificial Sequence
  derived and/or modified sequence from Influenza A H5N8 hemagglutinin
MGMRMMFIMFMLVVLATTVVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215075 - protein, 571 aa, Artificial Sequence
  derived and/or modified sequence from Influenza A H5N8 hemagglutinin
MARPLCTLLLLMATLAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215076 - protein, 576 aa, Artificial Sequence
  derived and/or modified sequence from Influenza A H5N8 hemagglutinin
MAISGVPVLGFFIIAVLMSAQESWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKIQIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNARELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215077 - RNA, 1710 nt, Artificial Sequence
  derived and/or modified sequence opt from Influenza A H5N8 hemagglutinin
augaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215078 - RNA, 1710 nt, Artificial Sequence
  derived and/or modified sequence opt from Influenza A H5N8 hemagglutinin
auggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215079 - RNA, 1728 nt, Artificial Sequence
  derived and/or modified sequence opt from Influenza A H5N8 hemagglutinin
augcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215080 - RNA, 1728 nt, Artificial Sequence
  derived and/or modified sequence opt from Influenza A H5N8 hemagglutinin
auggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215081 - RNA, 1731 nt, Artificial Sequence
  derived and/or modified sequence opt from Influenza A H5N8 hemagglutinin
auggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215082 - RNA, 1728 nt, Artificial Sequence
  derived and/or modified sequence opt from Influenza A H5N8 hemagglutinin
auggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215083 - RNA, 1713 nt, Artificial Sequence
  derived and/or modified sequence opt from Influenza A H5N8 hemagglutinin
augacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215084 - RNA, 1704 nt, Artificial Sequence
  derived and/or modified sequence opt from Influenza A H5N8 hemagglutinin
augccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215085 - RNA, 1713 nt, Artificial Sequence
  derived and/or modified sequence opt from Influenza A H5N8 hemagglutinin
augaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215086 - RNA, 1710 nt, Artificial Sequence
  derived and/or modified sequence opt from Influenza A H5N8 hemagglutinin
auggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215087 - RNA, 1707 nt, Artificial Sequence
  derived and/or modified sequence opt from Influenza A H5N8 hemagglutinin
augggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215088 - RNA, 1707 nt, Artificial Sequence
  derived and/or modified sequence opt from Influenza A H5N8 hemagglutinin
augggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215089 - RNA, 1707 nt, Artificial Sequence
  derived and/or modified sequence opt from Influenza A H5N8 hemagglutinin
augaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215090 - RNA, 1728 nt, Artificial Sequence
  derived and/or modified sequence opt from Influenza A H5N8 hemagglutinin
auggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215091 - RNA, 1716 nt, Artificial Sequence
  derived and/or modified sequence opt from Influenza A H5N8 hemagglutinin
auguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215092 - RNA, 1707 nt, Artificial Sequence
  derived and/or modified sequence opt from Influenza A H5N8 hemagglutinin
augcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215093 - RNA, 1725 nt, Artificial Sequence
  derived and/or modified sequence opt from Influenza A H5N8 hemagglutinin
auggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215094 - RNA, 1719 nt, Artificial Sequence
  derived and/or modified sequence opt from Influenza A H5N8 hemagglutinin
auggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215095 - RNA, 1722 nt, Artificial Sequence
  derived and/or modified sequence opt from Influenza A H5N8 hemagglutinin
auggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215096 - RNA, 1737 nt, Artificial Sequence
  derived and/or modified sequence opt from Influenza A H5N8 hemagglutinin
augggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215097 - RNA, 1713 nt, Artificial Sequence
  derived and/or modified sequence opt from Influenza A H5N8 hemagglutinin
auggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215098 - RNA, 1713 nt, Artificial Sequence
  derived and/or modified sequence opt from Influenza A H5N8 hemagglutinin
auggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215099 - RNA, 1713 nt, Artificial Sequence
  derived and/or modified sequence opt from Influenza A H5N8 hemagglutinin
auggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215100 - RNA, 1719 nt, Artificial Sequence
  derived and/or modified sequence opt from Influenza A H5N8 hemagglutinin
auggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215101 - RNA, 1734 nt, Artificial Sequence
  derived and/or modified sequence opt from Influenza A H5N8 hemagglutinin
augaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215102 - RNA, 1719 nt, Artificial Sequence
  derived and/or modified sequence opt from Influenza A H5N8 hemagglutinin
augggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215103 - RNA, 1716 nt, Artificial Sequence
  derived and/or modified sequence opt from Influenza A H5N8 hemagglutinin
auggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215104 - RNA, 1731 nt, Artificial Sequence
  derived and/or modified sequence opt from Influenza A H5N8 hemagglutinin
auggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucuga

SEQ ID NO: 215105 - RNA, 1927 nt, Artificial Sequence
  mRNA product opt Design1 from Influenza A H5N8 hemagglutinin
gggagaaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215106 - RNA, 1927 nt, Artificial Sequence
  mRNA product opt Design1 from Influenza A H5N8 hemagglutinin
gggagaaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215107 - RNA, 1945 nt, Artificial Sequence
  mRNA product opt Design1 from Influenza A H5N8 hemagglutinin
gggagaaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215108 - RNA, 1945 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215109 - RNA, 1948 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215110 - RNA, 1945 nt, Artificial Sequence
  mRNA product opt Design1 from Influenza A H5N8 hemagglutinin
gggagaaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215111 - RNA, 1930 nt, Artificial Sequence
  mRNA product opt Design1 from Influenza A H5N8 hemagglutinin
gggagaaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215112 - RNA, 1921 nt, Artificial Sequence
  mRNA product opt Design1 from Influenza A H5N8 hemagglutinin
gggagaaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215113 - RNA, 1930 nt, Artificial Sequence
  mRNA product opt Design1 from Influenza A H5N8 hemagglutinin
gggagaaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215114 - RNA, 1927 nt, Artificial Sequence
  mRNA product opt Design1 from Influenza A H5N8 hemagglutinin
gggagaaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215115 - RNA, 1924 nt, Artificial Sequence
  mRNA product opt Design1 from Influenza A H5N8 hemagglutinin
gggagaaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215116 - RNA, 1924 nt, Artificial Sequence
  mRNA product opt Design1 from Influenza A H5N8 hemagglutinin
gggagaaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215117 - RNA, 1924 nt, Artificial Sequence
  mRNA product opt Design1 from Influenza A H5N8 hemagglutinin
gggagaaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215118 - RNA, 1945 nt, Artificial Sequence
  mRNA product opt Design1 from Influenza A H5N8 hemagglutinin
gggagaaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215119 - RNA, 1933 nt, Artificial Sequence
  mRNA product opt Design1 from Influenza A H5N8 hemagglutinin
gggagaaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215120 - RNA, 1924 nt, Artificial Sequence
  mRNA product opt Design1 from Influenza A H5N8 hemagglutinin
gggagaaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215121 - RNA, 1942 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215122 - RNA, 1936 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215123 - RNA, 1939 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215124 - RNA, 1954 nt, Artificial Sequence
  mRNA product opt Design1 from Influenza A H5N8 hemagglutinin
gggagaaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215125 - RNA, 1930 nt, Artificial Sequence
  mRNA product opt Design1 from Influenza A H5N8 hemagglutinin
gggagaaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215126 - RNA, 1930 nt, Artificial Sequence
  mRNA product opt Design1 from Influenza A H5N8 hemagglutinin
gggagaaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215127 - RNA, 1930 nt, Artificial Sequence
  mRNA product opt Design1 from Influenza A H5N8 hemagglutinin
gggagaaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215128 - RNA, 1936 nt, Artificial Sequence
  mRNA product opt Design1 from Influenza A H5N8 hemagglutinin
gggagaaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215129 - RNA, 1951 nt, Artificial Sequence
  mRNA product opt Design1 from Influenza A H5N8 hemagglutinin
gggagaaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215130 - RNA, 1936 nt, Artificial Sequence
  mRNA product opt Design1 from Influenza A H5N8 hemagglutinin
gggagaaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215131 - RNA, 1933 nt, Artificial Sequence
  mRNA product opt Design1 from Influenza A H5N8 hemagglutinin
gggagaaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215132 - RNA, 1948 nt, Artificial Sequence
  mRNA product opt Design1 from Influenza A H5N8 hemagglutinin
gggagaaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215133 - RNA, 2092 nt, Artificial Sequence
  mRNA product opt Design2 from Influenza A H5N8 hemagglutinin
ggggcgcugccuacggagguggcagccaucuccuucucggcaucaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215134 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215135 - RNA, 2110 nt, Artificial Sequence
  mRNA product opt Design2 from Influenza A H5N8 hemagglutinin
ggggcgcugccuacggagguggcagccaucuccuucucggcaucaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215136 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215137 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215138 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215139 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215140 - RNA, 2086 nt, Artificial Sequence
  mRNA product opt Design2 from Influenza A H5N8 hemagglutinin
ggggcgcugccuacggagguggcagccaucuccuucucggcaucaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215141 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215142 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215143 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215144 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215145 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215146 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215147 - RNA, 2098 nt, Artificial Sequence
  mRNA product opt Design2 from Influenza A H5N8 hemagglutinin
ggggcgcugccuacggagguggcagccaucuccuucucggcaucaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215148 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215149 - RNA, 2107 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215150 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215151 - RNA, 2104 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215152 - RNA, 2119 nt, Artificial Sequence
  mRNA product opt Design2 from Influenza A H5N8 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215153 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215154 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215155 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215156 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215157 - RNA, 2116 nt, Artificial Sequence
  mRNA product opt Design2 from Influenza A H5N8 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215158 - RNA, 2101 nt, Artificial Sequence
  mRNA product opt Design2 from Influenza A H5N8 hemagglutinin
ggggcgcugccuacggagguggcagccaucuccuucucggcaucaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215159 - RNA, 2098 nt, Artificial Sequence
  mRNA product opt Design2 from Influenza A H5N8 hemagglutinin
ggggcgcugccuacggagguggcagccaucuccuucucggcaucaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215160 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccagaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcagccaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagagcgugcggaacgggacguacgacuacccccaguacuccgaggaggcccgccugaagcgcgaggagaucggcggggucaagcucgagagcaucggcaccuaccagauccuguccaucuacagcaccguggccuccagccuggcgcucgccaucaugguggccgggcugucccuguggaugugcagcaacggcucccuccagugccggaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215161 - protein, 567 aa, Artificial Sequence
  Influenza A H5N8 hemagglutinin
MENIVLLLAIVSLVKSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215162 - RNA, 1704 nt, Artificial Sequence
  Influenza A H5N8 hemagglutinin
auggagaacauagugcuucuucuugcaauaguuagccuuguuaaaagugaucagauuugcauugguuaccaugcaaacaacucgacagagcaaguugacacgauaauggaaaagaacgucacuguuacacaugcccaagacauacuggaaaaaacacacaacgggaagcucugcgaucuaaauggggugaagccucugauuuuaaaggauuguaguguagcuggauggcuccucggaaacccaaugugcgacgaauucaucagagugccggaauggucuuacauaguggagagggcuaauccagcuaaugaccucuguuacccagggagccucaauaacuaugaagaacugaaacaccuguugagcagaauaaaucauuuugagaagauucugaucauccccaagaguucuuggcccaaucaugaaacaucauuaggggugagcgcagccuguccauaccagggaacgcccuccuuuuucagaaaugugguauggcuuaucaaaaagaacgaugcauacccaacaauaaagauaagcuacaauaauaccaaucgggaagaucucuugauacuguggggaauucaucauuccaacaaugcagaagagcagacaaaucucuauaaaaacccaaccaccuauauuucaguuggaacaucaacauuaaaccagagauugguaccaaaaauagcuacuagaucccaaguaaacgggcaacguggaagaauggacuucuucuggacaauuuuaaaaccgaaugaugcaauccauuucgagaguaauggaaauuucauugcuccagaauaugcauacaaaauugucaagaaaggggacucaacaauuaugaaaaguggaguggaauauggccacugcaacaccaaaugucaaaccccaguaggagcgauaaacucuaguaugccguuccacaauauacauccucucaccaucggggaaugccccaaauacgugaagucaaacaaguugguccuugcgacugggcucagaaauaguccucuaagagaaaagagaagaaagagagggcuguuuggggcuauagcagguuuuauagagggaggauggcagggaaugguugaugguugguauggguaccaccauagcaaugagcaggggaguggguacgcugcagacaaagaauccacccaaaaggcaauagauggaguuaccaauaaggucaacucgaucauugacaaaaugaacacucaauuugaggcaguuggaagggaguuuaauaacuuagaaaggaggauagagaauuugaacaagaaaauggaagacggauuccuagaugucuggaccuauaaugcugaacuucuaguucucauggaaaacgagaggacucuagauuuccaugacucaaaugucaagaaccuuuacgacaaagucagacugcagcuuagggauaaugcaaaggagcuggguaacgguuguuucgaauucuaucacaaaugugauaaugaauguauggaaagugugagaaaugggacguaugacuacccucaguauucagaagaagcaagauuaaaaagagaagaaauaagcggagugaaauuagaaucaauaggaacuuaccaaauacugucaauuuauucaacaguggcgaguucccuagcacuggcaaucaugguggcuggucuaucuuuauggaugugcuccaaugggucguuacagugcagaauuugcauuuaa

SEQ ID NO: 215163 - RNA, 1704 nt, Artificial Sequence
  derived and/or modified sequence opt from Influenza A H5N8 hemagglutinin
auggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215164 - RNA, 1921 nt, Artificial Sequence
  mRNA product opt Design1 from Influenza A H5N8 hemagglutinin
gggagaaagcuuaccauggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215165 - RNA, 2086 nt, Artificial Sequence
  R5821 mRNA product opt Design2 from Influenza A H5N8 hemagglutinin
ggggcgcugccuacggagguggcagccaucuccuucucggcaucaagcuuaccauggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215166 - protein, 569 aa, Artificial Sequence
  derived and/or modified sequence from Influenza A H5N8 hemagglutinin
MKWVTFISLLFLFSSAYSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215167 - protein, 569 aa, Artificial Sequence
  derived and/or modified sequence from Influenza A H5N8 hemagglutinin
MDWTWILFLVAAATRVHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215168 - protein, 575 aa, Artificial Sequence
  derived and/or modified sequence from Influenza A H5N8 hemagglutinin
MPMGSLQPLATLYLLGMLVASCLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215169 - protein, 575 aa, Artificial Sequence
  derived and/or modified sequence from Influenza A H5N8 hemagglutinin
MAVMAPRTLVLLLSGALALTQTWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215170 - protein, 576 aa, Artificial Sequence
  derived and/or modified sequence from Influenza A H5N8 hemagglutinin
MAVMAPRTLVLLLSGALALTQTWAGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215171 - protein, 575 aa, Artificial Sequence
  derived and/or modified sequence from Influenza A H5N8 hemagglutinin
MASSLYSFLLALSIVYIFVAPTHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215172 - protein, 570 aa, Artificial Sequence
  derived and/or modified sequence from Influenza A H5N8 hemagglutinin
MTRLTVLALLAGLLASSRADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215173 - protein, 567 aa, Artificial Sequence
  derived and/or modified sequence from Influenza A H5N8 hemagglutinin
MPLLLLLPLLWAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215174 - protein, 570 aa, Artificial Sequence
  derived and/or modified sequence from Influenza A H5N8 hemagglutinin
MIKLKFGVFFTVLLSSAYADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215175 - protein, 569 aa, Artificial Sequence
  derived and/or modified sequence from Influenza A H5N8 hemagglutinin
MAFLWLLSCWALLGTTFGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215176 - protein, 568 aa, Artificial Sequence
  derived and/or modified sequence from Influenza A H5N8 hemagglutinin
MGVKVLFALICIAVAEADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215177 - protein, 568 aa, Artificial Sequence; identical to SEQ ID NO: 215176
  derived and/or modified sequence from Influenza A H5N8 hemagglutinin

SEQ ID NO: 215178 - protein, 568 aa, Artificial Sequence
  derived and/or modified sequence from Influenza A H5N8 hemagglutinin
MKAILVVLLYTFATANADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215179 - protein, 575 aa, Artificial Sequence
  derived and/or modified sequence from Influenza A H5N8 hemagglutinin
MALWMRLLPLLALLALWGPDPAAADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215180 - protein, 571 aa, Artificial Sequence
  derived and/or modified sequence from Influenza A H5N8 hemagglutinin
MYRMQLLSCIALSLALVTNSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215181 - protein, 568 aa, Artificial Sequence
  derived and/or modified sequence from Influenza A H5N8 hemagglutinin
MRAWIFFLLCLAGRALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215182 - protein, 574 aa, Artificial Sequence
  derived and/or modified sequence from Influenza A H5N8 hemagglutinin
MDAMKRGLCCVLLLCGAVFVSPSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215183 - protein, 572 aa, Artificial Sequence
  derived and/or modified sequence from Influenza A H5N8 hemagglutinin
MDAMKRGLCCVLLLCGAVFVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215184 - protein, 573 aa, Artificial Sequence
  derived and/or modified sequence from Influenza A H5N8 hemagglutinin
MDAMKRGLCCVLLLCGAVFVSPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215185 - protein, 578 aa, Artificial Sequence
  derived and/or modified sequence from Influenza A H5N8 hemagglutinin
MGVHECPAWLWLLLSLLSLPLGLPVLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215186 - protein, 570 aa, Artificial Sequence
  derived and/or modified sequence from Influenza A H5N8 hemagglutinin
MEFGLSWVFLVALFRGVQCDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215187 - protein, 570 aa, Artificial Sequence
  derived and/or modified sequence from Influenza A H5N8 hemagglutinin
MDWTWRVFCLLAVTPGAHPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215188 - protein, 570 aa, Artificial Sequence
  derived and/or modified sequence from Influenza A H5N8 hemagglutinin
MAWSPLFLTLITHCAGSWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215189 - protein, 572 aa, Artificial Sequence
  derived and/or modified sequence from Influenza A H5N8 hemagglutinin
METDTLLLWVLLLWVPGSTGDDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215190 - protein, 577 aa, Artificial Sequence
  derived and/or modified sequence from Influenza A H5N8 hemagglutinin
MKTHYSSAILPILTLFVFLSINPSHGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215191 - protein, 572 aa, Artificial Sequence
  derived and/or modified sequence from Influenza A H5N8 hemagglutinin
MGMRMMFIMFMLVVLATTVVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215192 - protein, 571 aa, Artificial Sequence
  derived and/or modified sequence from Influenza A H5N8 hemagglutinin
MARPLCTLLLLMATLAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215193 - protein, 576 aa, Artificial Sequence
  derived and/or modified sequence from Influenza A H5N8 hemagglutinin
MAISGVPVLGFFIIAVLMSAQESWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 215194 - RNA, 1710 nt, Artificial Sequence
  derived and/or modified sequence opt from Influenza A H5N8 hemagglutinin
augaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215195 - RNA, 1710 nt, Artificial Sequence
  derived and/or modified sequence opt from Influenza A H5N8 hemagglutinin
auggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215196 - RNA, 1728 nt, Artificial Sequence
  derived and/or modified sequence opt from Influenza A H5N8 hemagglutinin
augcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215197 - RNA, 1728 nt, Artificial Sequence
  derived and/or modified sequence opt from Influenza A H5N8 hemagglutinin
auggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215198 - RNA, 1731 nt, Artificial Sequence
  derived and/or modified sequence opt from Influenza A H5N8 hemagglutinin
auggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215199 - RNA, 1728 nt, Artificial Sequence
  derived and/or modified sequence opt from Influenza A H5N8 hemagglutinin
auggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215200 - RNA, 1713 nt, Artificial Sequence
  derived and/or modified sequence opt from Influenza A H5N8 hemagglutinin
augacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215201 - RNA, 1704 nt, Artificial Sequence
  derived and/or modified sequence opt from Influenza A H5N8 hemagglutinin
augccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215202 - RNA, 1713 nt, Artificial Sequence
  derived and/or modified sequence opt from Influenza A H5N8 hemagglutinin
augaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215203 - RNA, 1710 nt, Artificial Sequence
  derived and/or modified sequence opt from Influenza A H5N8 hemagglutinin
auggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215204 - RNA, 1707 nt, Artificial Sequence
  derived and/or modified sequence opt from Influenza A H5N8 hemagglutinin
augggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215205 - RNA, 1707 nt, Artificial Sequence
  derived and/or modified sequence opt from Influenza A H5N8 hemagglutinin
augggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215206 - RNA, 1707 nt, Artificial Sequence
  derived and/or modified sequence opt from Influenza A H5N8 hemagglutinin
augaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215207 - RNA, 1728 nt, Artificial Sequence
  derived and/or modified sequence opt from Influenza A H5N8 hemagglutinin
auggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215208 - RNA, 1716 nt, Artificial Sequence
  derived and/or modified sequence opt from Influenza A H5N8 hemagglutinin
auguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215209 - RNA, 1707 nt, Artificial Sequence
  derived and/or modified sequence opt from Influenza A H5N8 hemagglutinin
augcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215210 - RNA, 1725 nt, Artificial Sequence
  derived and/or modified sequence opt from Influenza A H5N8 hemagglutinin
auggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215211 - RNA, 1719 nt, Artificial Sequence
  derived and/or modified sequence opt from Influenza A H5N8 hemagglutinin
auggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215212 - RNA, 1722 nt, Artificial Sequence
  derived and/or modified sequence opt from Influenza A H5N8 hemagglutinin
auggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215213 - RNA, 1737 nt, Artificial Sequence
  derived and/or modified sequence opt from Influenza A H5N8 hemagglutinin
augggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215214 - RNA, 1713 nt, Artificial Sequence
  derived and/or modified sequence opt from Influenza A H5N8 hemagglutinin
auggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215215 - RNA, 1713 nt, Artificial Sequence
  derived and/or modified sequence opt from Influenza A H5N8 hemagglutinin
auggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215216 - RNA, 1713 nt, Artificial Sequence
  derived and/or modified sequence opt from Influenza A H5N8 hemagglutinin
auggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215217 - RNA, 1719 nt, Artificial Sequence
  derived and/or modified sequence opt from Influenza A H5N8 hemagglutinin
auggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215218 - RNA, 1734 nt, Artificial Sequence
  derived and/or modified sequence opt from Influenza A H5N8 hemagglutinin
augaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215219 - RNA, 1719 nt, Artificial Sequence
  derived and/or modified sequence opt from Influenza A H5N8 hemagglutinin
augggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215220 - RNA, 1716 nt, Artificial Sequence
  derived and/or modified sequence opt from Influenza A H5N8 hemagglutinin
auggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215221 - RNA, 1731 nt, Artificial Sequence
  derived and/or modified sequence opt from Influenza A H5N8 hemagglutinin
auggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215222 - RNA, 1927 nt, Artificial Sequence
  mRNA product opt Design1 from Influenza A H5N8 hemagglutinin
gggagaaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215223 - RNA, 1927 nt, Artificial Sequence
  mRNA product opt Design1 from Influenza A H5N8 hemagglutinin
gggagaaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215224 - RNA, 1945 nt, Artificial Sequence
  mRNA product opt Design1 from Influenza A H5N8 hemagglutinin
gggagaaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215225 - RNA, 1945 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215226 - RNA, 1948 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215227 - RNA, 1945 nt, Artificial Sequence
  mRNA product opt Design1 from Influenza A H5N8 hemagglutinin
gggagaaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215228 - RNA, 1930 nt, Artificial Sequence
  mRNA product opt Design1 from Influenza A H5N8 hemagglutinin
gggagaaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215229 - RNA, 1921 nt, Artificial Sequence
  mRNA product opt Design1 from Influenza A H5N8 hemagglutinin
gggagaaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215230 - RNA, 1930 nt, Artificial Sequence
  mRNA product opt Design1 from Influenza A H5N8 hemagglutinin
gggagaaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215231 - RNA, 1927 nt, Artificial Sequence
  mRNA product opt Design1 from Influenza A H5N8 hemagglutinin
gggagaaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215232 - RNA, 1924 nt, Artificial Sequence
  mRNA product opt Design1 from Influenza A H5N8 hemagglutinin
gggagaaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215233 - RNA, 1924 nt, Artificial Sequence
  mRNA product opt Design1 from Influenza A H5N8 hemagglutinin
gggagaaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215234 - RNA, 1924 nt, Artificial Sequence
  mRNA product opt Design1 from Influenza A H5N8 hemagglutinin
gggagaaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215235 - RNA, 1945 nt, Artificial Sequence
  mRNA product opt Design1 from Influenza A H5N8 hemagglutinin
gggagaaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215236 - RNA, 1933 nt, Artificial Sequence
  mRNA product opt Design1 from Influenza A H5N8 hemagglutinin
gggagaaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215237 - RNA, 1924 nt, Artificial Sequence
  mRNA product opt Design1 from Influenza A H5N8 hemagglutinin
gggagaaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215238 - RNA, 1942 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215239 - RNA, 1936 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215240 - RNA, 1939 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215241 - RNA, 1954 nt, Artificial Sequence
  mRNA product opt Design1 from Influenza A H5N8 hemagglutinin
gggagaaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215242 - RNA, 1930 nt, Artificial Sequence
  mRNA product opt Design1 from Influenza A H5N8 hemagglutinin
gggagaaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215243 - RNA, 1930 nt, Artificial Sequence
  mRNA product opt Design1 from Influenza A H5N8 hemagglutinin
gggagaaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215244 - RNA, 1930 nt, Artificial Sequence
  mRNA product opt Design1 from Influenza A H5N8 hemagglutinin
gggagaaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215245 - RNA, 1936 nt, Artificial Sequence
  mRNA product opt Design1 from Influenza A H5N8 hemagglutinin
gggagaaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215246 - RNA, 1951 nt, Artificial Sequence
  mRNA product opt Design1 from Influenza A H5N8 hemagglutinin
gggagaaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215247 - RNA, 1936 nt, Artificial Sequence
  mRNA product opt Design1 from Influenza A H5N8 hemagglutinin
gggagaaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215248 - RNA, 1933 nt, Artificial Sequence
  mRNA product opt Design1 from Influenza A H5N8 hemagglutinin
gggagaaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215249 - RNA, 1948 nt, Artificial Sequence
  mRNA product opt Design1 from Influenza A H5N8 hemagglutinin
gggagaaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215250 - RNA, 2092 nt, Artificial Sequence
  mRNA product opt Design2 from Influenza A H5N8 hemagglutinin
ggggcgcugccuacggagguggcagccaucuccuucucggcaucaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215251 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215252 - RNA, 2110 nt, Artificial Sequence
  mRNA product opt Design2 from Influenza A H5N8 hemagglutinin
ggggcgcugccuacggagguggcagccaucuccuucucggcaucaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215253 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215254 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215255 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215256 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215257 - RNA, 2086 nt, Artificial Sequence
  mRNA product opt Design2 from Influenza A H5N8 hemagglutinin
ggggcgcugccuacggagguggcagccaucuccuucucggcaucaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215258 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215259 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215260 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215261 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215262 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215263 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215264 - RNA, 2098 nt, Artificial Sequence
  mRNA product opt Design2 from Influenza A H5N8 hemagglutinin
ggggcgcugccuacggagguggcagccaucuccuucucggcaucaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215265 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215266 - RNA, 2107 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215267 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215268 - RNA, 2104 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215269 - RNA, 2119 nt, Artificial Sequence
  mRNA product opt Design2 from Influenza A H5N8 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215270 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215271 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215272 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215273 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215274 - RNA, 2116 nt, Artificial Sequence
  mRNA product opt Design2 from Influenza A H5N8 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215275 - RNA, 2101 nt, Artificial Sequence
  mRNA product opt Design2 from Influenza A H5N8 hemagglutinin
ggggcgcugccuacggagguggcagccaucuccuucucggcaucaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215276 - RNA, 2098 nt, Artificial Sequence
  mRNA product opt Design2 from Influenza A H5N8 hemagglutinin
ggggcgcugccuacggagguggcagccaucuccuucucggcaucaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215277 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215278 - protein, 567 aa, Artificial Sequence
  Influenza A H5N8 hemagglutinin
MENIVLLLAIVSLVKSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215279 - RNA, 1704 nt, Artificial Sequence
  Influenza A H5N8 hemagglutinin
auggagaacauagugcuucuucuugcaauaguuagccuuguuaaaagugaucagauuugcauugguuaccaugcaaacaacucgacagagcaaguugacacgauaauggaaaagaacgucacuguuacacaugcccaagacauacuggaaaaaacacacaacgggaagcucugcgaucuaaauggggugaagccucugauuuuaaaggauuguaguguagcuggauggcuccucggaaacccaaugugcgacgaauucaucagagugccggaauggucuuacauaguggagagggcuaacccagcuaaugaccucuguuacccagggagccucaaugacuaugaagaacugaaacaccuguugagcagaauaaaucauuuugagaagauucugaucauccccaagaguucuuggcccaaucaugaaacaucauuagggguaagcgcagcuuguccauaucagggaacgcccuccuuuuucagaaaugugguauggcuuaucaaaaagaacgaugcauacccaacaauaaagauaagcuacaauaauaccaaucgggaagaucucuugauacugugggggauucaucauuccaacaaugcagaagagcagacaaaucucuacaaaaacccaaccaccuauauuucaguuggaacaucaacauuaaaccagagauugguaccaaaaauagcuacuagaucccaaguaaacgggcaacguggaagaauggacuucuucuggacaauuuuaaaaccgaaugaugcaauccacuucgagaguaauggaaauuucauugcuccagaauaugcauacaaaauugucaagaaaggggacucaacaauuaugaaaaguggaguggaauauggccacugcaacaccaaaugucaaaccccaguaggagcaauaaacucuaguaugccguuccacaauauacauccucucaccaucggggaaugccccaaauacgugaagucaaacaaguugguccuugcgacugggcucagaaauaguccucuaagagaaaagagaagaaaaagagggcuguuuggggcuauagcagguuuuauagagggaggauggcagggaaugguugaugguugguauggguaccaccauagcaaugagcaggggaguggguacgcugcagacaaagaauccacccaaaaggcaauagauggaguuaccaauaaggucaacucgaucauugacaaaaugaacacucaauuugaggcaguuggaagggaguuuaauaacuuagaaaggaggauagagaauuugaacaagaaaauggaagacggauuccuagaugucuggaccuauaaugcugaacuucuaguucucauggaaaacgagaggacucuagauuuccaugacucaaaugucaagaaccuuuacgacaaagucagacugcagcuuagggauaaugcaaaggagcuggguaacgguuguuucgaguucuaucacaaaugugauaaugaauguauggaaagugugagaaaugggacguaugacuacccucaguauucagaagaagcaagauuaaaaagagaagaaauaggcggagugaaauuagaaucaauaggaacuuaccaaauacugucaauuuauucaacaguggcgaguucccuagcacuggcaaucaugguggcuggucuaucuuuauggaugugcuccaaugggucguuacagugcagaauuugcauuuaa

SEQ ID NO: 215280 - RNA, 1704 nt, Artificial Sequence
  derived and/or modified sequence opt from Influenza A H5N8 hemagglutinin
auggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215281 - RNA, 1921 nt, Artificial Sequence
  mRNA product opt Design1 from Influenza A H5N8 hemagglutinin
gggagaaagcuuaccauggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215282 - RNA, 2086 nt, Artificial Sequence
  R5820 mRNA product opt Design2 from Influenza A H5N8 hemagglutinin
ggggcgcugccuacggagguggcagccaucuccuucucggcaucaagcuuaccauggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215283 - protein, 569 aa, Artificial Sequence
  derived and/or modified sequence from Influenza A H5N8 hemagglutinin
MKWVTFISLLFLFSSAYSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215284 - protein, 569 aa, Artificial Sequence
  derived and/or modified sequence from Influenza A H5N8 hemagglutinin
MDWTWILFLVAAATRVHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215285 - protein, 575 aa, Artificial Sequence
  derived and/or modified sequence from Influenza A H5N8 hemagglutinin
MPMGSLQPLATLYLLGMLVASCLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215286 - protein, 575 aa, Artificial Sequence
  derived and/or modified sequence from Influenza A H5N8 hemagglutinin
MAVMAPRTLVLLLSGALALTQTWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215287 - protein, 576 aa, Artificial Sequence
  derived and/or modified sequence from Influenza A H5N8 hemagglutinin
MAVMAPRTLVLLLSGALALTQTWAGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215288 - protein, 575 aa, Artificial Sequence
  derived and/or modified sequence from Influenza A H5N8 hemagglutinin
MASSLYSFLLALSIVYIFVAPTHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215289 - protein, 570 aa, Artificial Sequence
  derived and/or modified sequence from Influenza A H5N8 hemagglutinin
MTRLTVLALLAGLLASSRADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215290 - protein, 567 aa, Artificial Sequence
  derived and/or modified sequence from Influenza A H5N8 hemagglutinin
MPLLLLLPLLWAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215291 - protein, 570 aa, Artificial Sequence
  derived and/or modified sequence from Influenza A H5N8 hemagglutinin
MIKLKFGVFFTVLLSSAYADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215292 - protein, 569 aa, Artificial Sequence
  derived and/or modified sequence from Influenza A H5N8 hemagglutinin
MAFLWLLSCWALLGTTFGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215293 - protein, 568 aa, Artificial Sequence
  derived and/or modified sequence from Influenza A H5N8 hemagglutinin
MGVKVLFALICIAVAEADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215294 - protein, 568 aa, Artificial Sequence; identical to SEQ ID NO: 215293
  derived and/or modified sequence from Influenza A H5N8 hemagglutinin

SEQ ID NO: 215295 - protein, 568 aa, Artificial Sequence
  derived and/or modified sequence from Influenza A H5N8 hemagglutinin
MKAILVVLLYTFATANADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215296 - protein, 575 aa, Artificial Sequence
  derived and/or modified sequence from Influenza A H5N8 hemagglutinin
MALWMRLLPLLALLALWGPDPAAADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215297 - protein, 571 aa, Artificial Sequence
  derived and/or modified sequence from Influenza A H5N8 hemagglutinin
MYRMQLLSCIALSLALVTNSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215298 - protein, 568 aa, Artificial Sequence
  derived and/or modified sequence from Influenza A H5N8 hemagglutinin
MRAWIFFLLCLAGRALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215299 - protein, 574 aa, Artificial Sequence
  derived and/or modified sequence from Influenza A H5N8 hemagglutinin
MDAMKRGLCCVLLLCGAVFVSPSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215300 - protein, 572 aa, Artificial Sequence
  derived and/or modified sequence from Influenza A H5N8 hemagglutinin
MDAMKRGLCCVLLLCGAVFVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215301 - protein, 573 aa, Artificial Sequence
  derived and/or modified sequence from Influenza A H5N8 hemagglutinin
MDAMKRGLCCVLLLCGAVFVSPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215302 - protein, 578 aa, Artificial Sequence
  derived and/or modified sequence from Influenza A H5N8 hemagglutinin
MGVHECPAWLWLLLSLLSLPLGLPVLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215303 - protein, 570 aa, Artificial Sequence
  derived and/or modified sequence from Influenza A H5N8 hemagglutinin
MEFGLSWVFLVALFRGVQCDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215304 - protein, 570 aa, Artificial Sequence
  derived and/or modified sequence from Influenza A H5N8 hemagglutinin
MDWTWRVFCLLAVTPGAHPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215305 - protein, 570 aa, Artificial Sequence
  derived and/or modified sequence from Influenza A H5N8 hemagglutinin
MAWSPLFLTLITHCAGSWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215306 - protein, 572 aa, Artificial Sequence
  derived and/or modified sequence from Influenza A H5N8 hemagglutinin
METDTLLLWVLLLWVPGSTGDDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215307 - protein, 577 aa, Artificial Sequence
  derived and/or modified sequence from Influenza A H5N8 hemagglutinin
MKTHYSSAILPILTLFVFLSINPSHGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215308 - protein, 572 aa, Artificial Sequence
  derived and/or modified sequence from Influenza A H5N8 hemagglutinin
MGMRMMFIMFMLVVLATTVVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215309 - protein, 571 aa, Artificial Sequence
  derived and/or modified sequence from Influenza A H5N8 hemagglutinin
MARPLCTLLLLMATLAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215310 - protein, 576 aa, Artificial Sequence
  derived and/or modified sequence from Influenza A H5N8 hemagglutinin
MAISGVPVLGFFIIAVLMSAQESWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNDYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEIGGVKLESIGTYQILSIYSTVASSLALAIMVAGLSLWMCSNGSLQCRICI

SEQ ID NO: 215311 - RNA, 1710 nt, Artificial Sequence
  derived and/or modified sequence opt from Influenza A H5N8 hemagglutinin
augaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215312 - RNA, 1710 nt, Artificial Sequence
  derived and/or modified sequence opt from Influenza A H5N8 hemagglutinin
auggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215313 - RNA, 1728 nt, Artificial Sequence
  derived and/or modified sequence opt from Influenza A H5N8 hemagglutinin
augcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215314 - RNA, 1728 nt, Artificial Sequence
  derived and/or modified sequence opt from Influenza A H5N8 hemagglutinin
auggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215315 - RNA, 1731 nt, Artificial Sequence
  derived and/or modified sequence opt from Influenza A H5N8 hemagglutinin
auggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215316 - RNA, 1728 nt, Artificial Sequence
  derived and/or modified sequence opt from Influenza A H5N8 hemagglutinin
auggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215317 - RNA, 1713 nt, Artificial Sequence
  derived and/or modified sequence opt from Influenza A H5N8 hemagglutinin
augacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215318 - RNA, 1704 nt, Artificial Sequence
  derived and/or modified sequence opt from Influenza A H5N8 hemagglutinin
augccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215319 - RNA, 1713 nt, Artificial Sequence
  derived and/or modified sequence opt from Influenza A H5N8 hemagglutinin
augaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215320 - RNA, 1710 nt, Artificial Sequence
  derived and/or modified sequence opt from Influenza A H5N8 hemagglutinin
auggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215321 - RNA, 1707 nt, Artificial Sequence
  derived and/or modified sequence opt from Influenza A H5N8 hemagglutinin
augggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215322 - RNA, 1707 nt, Artificial Sequence
  derived and/or modified sequence opt from Influenza A H5N8 hemagglutinin
augggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215323 - RNA, 1707 nt, Artificial Sequence
  derived and/or modified sequence opt from Influenza A H5N8 hemagglutinin
augaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215324 - RNA, 1728 nt, Artificial Sequence
  derived and/or modified sequence opt from Influenza A H5N8 hemagglutinin
auggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215325 - RNA, 1716 nt, Artificial Sequence
  derived and/or modified sequence opt from Influenza A H5N8 hemagglutinin
auguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215326 - RNA, 1707 nt, Artificial Sequence
  derived and/or modified sequence opt from Influenza A H5N8 hemagglutinin
augcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215327 - RNA, 1725 nt, Artificial Sequence
  derived and/or modified sequence opt from Influenza A H5N8 hemagglutinin
auggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215328 - RNA, 1719 nt, Artificial Sequence
  derived and/or modified sequence opt from Influenza A H5N8 hemagglutinin
auggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215329 - RNA, 1722 nt, Artificial Sequence
  derived and/or modified sequence opt from Influenza A H5N8 hemagglutinin
auggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215330 - RNA, 1737 nt, Artificial Sequence
  derived and/or modified sequence opt from Influenza A H5N8 hemagglutinin
augggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215331 - RNA, 1713 nt, Artificial Sequence
  derived and/or modified sequence opt from Influenza A H5N8 hemagglutinin
auggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215332 - RNA, 1713 nt, Artificial Sequence
  derived and/or modified sequence opt from Influenza A H5N8 hemagglutinin
auggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215333 - RNA, 1713 nt, Artificial Sequence
  derived and/or modified sequence opt from Influenza A H5N8 hemagglutinin
auggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215334 - RNA, 1719 nt, Artificial Sequence
  derived and/or modified sequence opt from Influenza A H5N8 hemagglutinin
auggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215335 - RNA, 1734 nt, Artificial Sequence
  derived and/or modified sequence opt from Influenza A H5N8 hemagglutinin
augaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215336 - RNA, 1719 nt, Artificial Sequence
  derived and/or modified sequence opt from Influenza A H5N8 hemagglutinin
augggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215337 - RNA, 1716 nt, Artificial Sequence
  derived and/or modified sequence opt from Influenza A H5N8 hemagglutinin
auggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215338 - RNA, 1731 nt, Artificial Sequence
  derived and/or modified sequence opt from Influenza A H5N8 hemagglutinin
auggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucuga

SEQ ID NO: 215339 - RNA, 1927 nt, Artificial Sequence
  mRNA product opt Design1 from Influenza A H5N8 hemagglutinin
gggagaaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215340 - RNA, 1927 nt, Artificial Sequence
  mRNA product opt Design1 from Influenza A H5N8 hemagglutinin
gggagaaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215341 - RNA, 1945 nt, Artificial Sequence
  mRNA product opt Design1 from Influenza A H5N8 hemagglutinin
gggagaaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215342 - RNA, 1945 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215343 - RNA, 1948 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215344 - RNA, 1945 nt, Artificial Sequence
  mRNA product opt Design1 from Influenza A H5N8 hemagglutinin
gggagaaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215345 - RNA, 1930 nt, Artificial Sequence
  mRNA product opt Design1 from Influenza A H5N8 hemagglutinin
gggagaaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215346 - RNA, 1921 nt, Artificial Sequence
  mRNA product opt Design1 from Influenza A H5N8 hemagglutinin
gggagaaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215347 - RNA, 1930 nt, Artificial Sequence
  mRNA product opt Design1 from Influenza A H5N8 hemagglutinin
gggagaaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215348 - RNA, 1927 nt, Artificial Sequence
  mRNA product opt Design1 from Influenza A H5N8 hemagglutinin
gggagaaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215349 - RNA, 1924 nt, Artificial Sequence
  mRNA product opt Design1 from Influenza A H5N8 hemagglutinin
gggagaaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215350 - RNA, 1924 nt, Artificial Sequence
  mRNA product opt Design1 from Influenza A H5N8 hemagglutinin
gggagaaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215351 - RNA, 1924 nt, Artificial Sequence
  mRNA product opt Design1 from Influenza A H5N8 hemagglutinin
gggagaaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215352 - RNA, 1945 nt, Artificial Sequence
  mRNA product opt Design1 from Influenza A H5N8 hemagglutinin
gggagaaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215353 - RNA, 1933 nt, Artificial Sequence
  mRNA product opt Design1 from Influenza A H5N8 hemagglutinin
gggagaaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215354 - RNA, 1924 nt, Artificial Sequence
  mRNA product opt Design1 from Influenza A H5N8 hemagglutinin
gggagaaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215355 - RNA, 1942 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215356 - RNA, 1936 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215357 - RNA, 1939 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215358 - RNA, 1954 nt, Artificial Sequence
  mRNA product opt Design1 from Influenza A H5N8 hemagglutinin
gggagaaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215359 - RNA, 1930 nt, Artificial Sequence
  mRNA product opt Design1 from Influenza A H5N8 hemagglutinin
gggagaaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215360 - RNA, 1930 nt, Artificial Sequence
  mRNA product opt Design1 from Influenza A H5N8 hemagglutinin
gggagaaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215361 - RNA, 1930 nt, Artificial Sequence
  mRNA product opt Design1 from Influenza A H5N8 hemagglutinin
gggagaaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215362 - RNA, 1936 nt, Artificial Sequence
  mRNA product opt Design1 from Influenza A H5N8 hemagglutinin
gggagaaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215363 - RNA, 1951 nt, Artificial Sequence
  mRNA product opt Design1 from Influenza A H5N8 hemagglutinin
gggagaaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215364 - RNA, 1936 nt, Artificial Sequence
  mRNA product opt Design1 from Influenza A H5N8 hemagglutinin
gggagaaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215365 - RNA, 1933 nt, Artificial Sequence
  mRNA product opt Design1 from Influenza A H5N8 hemagglutinin
gggagaaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215366 - RNA, 1948 nt, Artificial Sequence
  mRNA product opt Design1 from Influenza A H5N8 hemagglutinin
gggagaaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215367 - RNA, 2092 nt, Artificial Sequence
  mRNA product opt Design2 from Influenza A H5N8 hemagglutinin
ggggcgcugccuacggagguggcagccaucuccuucucggcaucaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215368 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215369 - RNA, 2110 nt, Artificial Sequence
  mRNA product opt Design2 from Influenza A H5N8 hemagglutinin
ggggcgcugccuacggagguggcagccaucuccuucucggcaucaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215370 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215371 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215372 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215373 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215374 - RNA, 2086 nt, Artificial Sequence
  mRNA product opt Design2 from Influenza A H5N8 hemagglutinin
ggggcgcugccuacggagguggcagccaucuccuucucggcaucaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215375 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215376 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215377 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215378 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215379 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215380 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215381 - RNA, 2098 nt, Artificial Sequence
  mRNA product opt Design2 from Influenza A H5N8 hemagglutinin
ggggcgcugccuacggagguggcagccaucuccuucucggcaucaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215382 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215383 - RNA, 2107 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215384 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215385 - RNA, 2104 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215386 - RNA, 2119 nt, Artificial Sequence
  mRNA product opt Design2 from Influenza A H5N8 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215387 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215388 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215389 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215390 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215391 - RNA, 2116 nt, Artificial Sequence
  mRNA product opt Design2 from Influenza A H5N8 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215392 - RNA, 2101 nt, Artificial Sequence
  mRNA product opt Design2 from Influenza A H5N8 hemagglutinin
ggggcgcugccuacggagguggcagccaucuccuucucggcaucaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215393 - RNA, 2098 nt, Artificial Sequence
  mRNA product opt Design2 from Influenza A H5N8 hemagglutinin
ggggcgcugccuacggagguggcagccaucuccuucucggcaucaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215394 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagagcaucggcaccuaccagauccuguccaucuacagcaccguggccuccagccucgcgcuggccaucaugguggccgggcugucccucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215395 - protein, 567 aa, Artificial Sequence
  Influenza A H5N8 hemagglutinin
MENIVLLLAIVSLVKSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215396 - RNA, 1704 nt, Artificial Sequence
  Influenza A H5N8 hemagglutinin
auggagaacauagugcuucuucuugcaauaguuagccuuguuaaaagugaucagauuugcauugguuaccaugcaaacaacucgacagagcaaguugacacgauaauggaaaagaacgucacuguuacacaugcccaagacauacuggaaaaaacacacaacgggaagcucugcgaucuaaauggggugaagccucugauuuuaaaggauuguaguguagcuggauggcuccucggaaacccaaugugcgacgaauucaucagagugccggaauggucuuacauaguggagagggcuaacccagcuaaugaccucuguuacccagggagccucaauaacuaugaagaacugaaacaccuguugagcagaauaaaucauuuugagaagauucugaucauccccaagaguucuuggcccaaucaugaaacaucauuaggggugagcgcagccuguccauaccagggaacgcccuccuuuuucagaaaugugguauggcucaucaaaaagaacgaugcauacccaacaauaaagauaagcuacaauaauaccaaucgggaagaucucuugauacuguggggaauucaucauuccaacaaugcagaagagcagacaaaucucuauaaaaacccaaccaccuauauuucaguuggaacaucaacauuaaaccagagauugguaccaaaaauagcuacuagaucccaaguaaacgggcaacguggaagaauggacuucuucuggacaauuuuaaaaccgaaugaugcaauccauuucgagaguaauggaaauuucauugcuccagaauaugcauacaaaauugucaagaaaggggacucaacaauuaugaaaaguggaguggaauauggccacugcaacaccaaaugucaaaccccaguaggagcgauaaacucuaguaugccguuccacaauauacauccucucaccaucggggaaugccccaaauacgugaagucaaacaaguugguccuugcgacugggcucagaaauaguccucuaagagaaaagagaagaaagagagggcuguuuggggcuauagcagguuuuauagagggaggauggcagggaaugguugaugguugguauggguaccaccauagcaaugagcaggggaguggguacgcugcagacaaagaauccacccaaaaggcaauagauggaguuaccaauaaggucaacucgaucauugacaaaaugaacacucaauuugaggcaguuggaagggaguuuaauaacuuagaaaggaggauagagaauuugaacaagaaaauggaagacggauuccuagaugucuggaccuauaaugcugaacuucuaguucucauggaaaacgagaggacucuagauuuccaugacucaaaugucaagaaccuuuacgacaaagucagacugcagcuuagggauaaugcaaaggagcuggguaacgguuguuucgaauucuaucacaaaugugaugaugaauguauggaaagugugagaaaugggacguaugacuacccucaguauucagaagaagcaagauuaaaaagagaagaaauaagcggagugaaauuagaaucaauaggaacuuaccaaauacugucaauuuauucaacaguggcgaguucccuagcacuggcaaucaugguggcuggucuaucuuuauggaugugcuccaaugggucguuacagugcagaauuugcauuuaa

SEQ ID NO: 215397 - RNA, 1704 nt, Artificial Sequence
  derived and/or modified sequence opt from Influenza A H5N8 hemagglutinin
auggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215398 - RNA, 1921 nt, Artificial Sequence
  mRNA product opt Design1 from Influenza A H5N8 hemagglutinin
gggagaaagcuuaccauggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215399 - RNA, 2086 nt, Artificial Sequence
  R5820 mRNA product opt Design2 from Influenza A H5N8 hemagglutinin
ggggcgcugccuacggagguggcagccaucuccuucucggcaucaagcuuaccauggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215400 - protein, 569 aa, Artificial Sequence
  derived and/or modified sequence from Influenza A H5N8 hemagglutinin
MKWVTFISLLFLFSSAYSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215401 - protein, 569 aa, Artificial Sequence
  derived and/or modified sequence from Influenza A H5N8 hemagglutinin
MDWTWILFLVAAATRVHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215402 - protein, 575 aa, Artificial Sequence
  derived and/or modified sequence from Influenza A H5N8 hemagglutinin
MPMGSLQPLATLYLLGMLVASCLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215403 - protein, 575 aa, Artificial Sequence
  derived and/or modified sequence from Influenza A H5N8 hemagglutinin
MAVMAPRTLVLLLSGALALTQTWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215404 - protein, 576 aa, Artificial Sequence
  derived and/or modified sequence from Influenza A H5N8 hemagglutinin
MAVMAPRTLVLLLSGALALTQTWAGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215405 - protein, 575 aa, Artificial Sequence
  derived and/or modified sequence from Influenza A H5N8 hemagglutinin
MASSLYSFLLALSIVYIFVAPTHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215406 - protein, 570 aa, Artificial Sequence
  derived and/or modified sequence from Influenza A H5N8 hemagglutinin
MTRLTVLALLAGLLASSRADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215407 - protein, 567 aa, Artificial Sequence
  derived and/or modified sequence from Influenza A H5N8 hemagglutinin
MPLLLLLPLLWAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215408 - protein, 570 aa, Artificial Sequence
  derived and/or modified sequence from Influenza A H5N8 hemagglutinin
MIKLKFGVFFTVLLSSAYADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215409 - protein, 569 aa, Artificial Sequence
  derived and/or modified sequence from Influenza A H5N8 hemagglutinin
MAFLWLLSCWALLGTTFGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215410 - protein, 568 aa, Artificial Sequence
  derived and/or modified sequence from Influenza A H5N8 hemagglutinin
MGVKVLFALICIAVAEADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215411 - protein, 568 aa, Artificial Sequence; identical to SEQ ID NO: 215410
  derived and/or modified sequence from Influenza A H5N8 hemagglutinin

SEQ ID NO: 215412 - protein, 568 aa, Artificial Sequence
  derived and/or modified sequence from Influenza A H5N8 hemagglutinin
MKAILVVLLYTFATANADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215413 - protein, 575 aa, Artificial Sequence
  derived and/or modified sequence from Influenza A H5N8 hemagglutinin
MALWMRLLPLLALLALWGPDPAAADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215414 - protein, 571 aa, Artificial Sequence
  derived and/or modified sequence from Influenza A H5N8 hemagglutinin
MYRMQLLSCIALSLALVTNSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215415 - protein, 568 aa, Artificial Sequence
  derived and/or modified sequence from Influenza A H5N8 hemagglutinin
MRAWIFFLLCLAGRALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215416 - protein, 574 aa, Artificial Sequence
  derived and/or modified sequence from Influenza A H5N8 hemagglutinin
MDAMKRGLCCVLLLCGAVFVSPSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215417 - protein, 572 aa, Artificial Sequence
  derived and/or modified sequence from Influenza A H5N8 hemagglutinin
MDAMKRGLCCVLLLCGAVFVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215418 - protein, 573 aa, Artificial Sequence
  derived and/or modified sequence from Influenza A H5N8 hemagglutinin
MDAMKRGLCCVLLLCGAVFVSPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215419 - protein, 578 aa, Artificial Sequence
  derived and/or modified sequence from Influenza A H5N8 hemagglutinin
MGVHECPAWLWLLLSLLSLPLGLPVLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215420 - protein, 570 aa, Artificial Sequence
  derived and/or modified sequence from Influenza A H5N8 hemagglutinin
MEFGLSWVFLVALFRGVQCDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215421 - protein, 570 aa, Artificial Sequence
  derived and/or modified sequence from Influenza A H5N8 hemagglutinin
MDWTWRVFCLLAVTPGAHPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215422 - protein, 570 aa, Artificial Sequence
  derived and/or modified sequence from Influenza A H5N8 hemagglutinin
MAWSPLFLTLITHCAGSWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215423 - protein, 572 aa, Artificial Sequence
  derived and/or modified sequence from Influenza A H5N8 hemagglutinin
METDTLLLWVLLLWVPGSTGDDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215424 - protein, 577 aa, Artificial Sequence
  derived and/or modified sequence from Influenza A H5N8 hemagglutinin
MKTHYSSAILPILTLFVFLSINPSHGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215425 - protein, 572 aa, Artificial Sequence
  derived and/or modified sequence from Influenza A H5N8 hemagglutinin
MGMRMMFIMFMLVVLATTVVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215426 - protein, 571 aa, Artificial Sequence
  derived and/or modified sequence from Influenza A H5N8 hemagglutinin
MARPLCTLLLLMATLAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215427 - protein, 576 aa, Artificial Sequence
  derived and/or modified sequence from Influenza A H5N8 hemagglutinin
MAISGVPVLGFFIIAVLMSAQESWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 215428 - RNA, 1710 nt, Artificial Sequence
  derived and/or modified sequence opt from Influenza A H5N8 hemagglutinin
augaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215429 - RNA, 1710 nt, Artificial Sequence
  derived and/or modified sequence opt from Influenza A H5N8 hemagglutinin
auggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215430 - RNA, 1728 nt, Artificial Sequence
  derived and/or modified sequence opt from Influenza A H5N8 hemagglutinin
augcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215431 - RNA, 1728 nt, Artificial Sequence
  derived and/or modified sequence opt from Influenza A H5N8 hemagglutinin
auggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215432 - RNA, 1731 nt, Artificial Sequence
  derived and/or modified sequence opt from Influenza A H5N8 hemagglutinin
auggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215433 - RNA, 1728 nt, Artificial Sequence
  derived and/or modified sequence opt from Influenza A H5N8 hemagglutinin
auggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215434 - RNA, 1713 nt, Artificial Sequence
  derived and/or modified sequence opt from Influenza A H5N8 hemagglutinin
augacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215435 - RNA, 1704 nt, Artificial Sequence
  derived and/or modified sequence opt from Influenza A H5N8 hemagglutinin
augccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215436 - RNA, 1713 nt, Artificial Sequence
  derived and/or modified sequence opt from Influenza A H5N8 hemagglutinin
augaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215437 - RNA, 1710 nt, Artificial Sequence
  derived and/or modified sequence opt from Influenza A H5N8 hemagglutinin
auggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215438 - RNA, 1707 nt, Artificial Sequence
  derived and/or modified sequence opt from Influenza A H5N8 hemagglutinin
augggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215439 - RNA, 1707 nt, Artificial Sequence
  derived and/or modified sequence opt from Influenza A H5N8 hemagglutinin
augggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215440 - RNA, 1707 nt, Artificial Sequence
  derived and/or modified sequence opt from Influenza A H5N8 hemagglutinin
augaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215441 - RNA, 1728 nt, Artificial Sequence
  derived and/or modified sequence opt from Influenza A H5N8 hemagglutinin
auggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215442 - RNA, 1716 nt, Artificial Sequence
  derived and/or modified sequence opt from Influenza A H5N8 hemagglutinin
auguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215443 - RNA, 1707 nt, Artificial Sequence
  derived and/or modified sequence opt from Influenza A H5N8 hemagglutinin
augcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215444 - RNA, 1725 nt, Artificial Sequence
  derived and/or modified sequence opt from Influenza A H5N8 hemagglutinin
auggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215445 - RNA, 1719 nt, Artificial Sequence
  derived and/or modified sequence opt from Influenza A H5N8 hemagglutinin
auggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215446 - RNA, 1722 nt, Artificial Sequence
  derived and/or modified sequence opt from Influenza A H5N8 hemagglutinin
auggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215447 - RNA, 1737 nt, Artificial Sequence
  derived and/or modified sequence opt from Influenza A H5N8 hemagglutinin
augggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215448 - RNA, 1713 nt, Artificial Sequence
  derived and/or modified sequence opt from Influenza A H5N8 hemagglutinin
auggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215449 - RNA, 1713 nt, Artificial Sequence
  derived and/or modified sequence opt from Influenza A H5N8 hemagglutinin
auggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215450 - RNA, 1713 nt, Artificial Sequence
  derived and/or modified sequence opt from Influenza A H5N8 hemagglutinin
auggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215451 - RNA, 1719 nt, Artificial Sequence
  derived and/or modified sequence opt from Influenza A H5N8 hemagglutinin
auggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215452 - RNA, 1734 nt, Artificial Sequence
  derived and/or modified sequence opt from Influenza A H5N8 hemagglutinin
augaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215453 - RNA, 1719 nt, Artificial Sequence
  derived and/or modified sequence opt from Influenza A H5N8 hemagglutinin
augggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215454 - RNA, 1716 nt, Artificial Sequence
  derived and/or modified sequence opt from Influenza A H5N8 hemagglutinin
auggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215455 - RNA, 1731 nt, Artificial Sequence
  derived and/or modified sequence opt from Influenza A H5N8 hemagglutinin
auggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215456 - RNA, 1927 nt, Artificial Sequence
  mRNA product opt Design1 from Influenza A H5N8 hemagglutinin
gggagaaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215457 - RNA, 1927 nt, Artificial Sequence
  mRNA product opt Design1 from Influenza A H5N8 hemagglutinin
gggagaaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215458 - RNA, 1945 nt, Artificial Sequence
  mRNA product opt Design1 from Influenza A H5N8 hemagglutinin
gggagaaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215459 - RNA, 1945 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215460 - RNA, 1948 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215461 - RNA, 1945 nt, Artificial Sequence
  mRNA product opt Design1 from Influenza A H5N8 hemagglutinin
gggagaaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215462 - RNA, 1930 nt, Artificial Sequence
  mRNA product opt Design1 from Influenza A H5N8 hemagglutinin
gggagaaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215463 - RNA, 1921 nt, Artificial Sequence
  mRNA product opt Design1 from Influenza A H5N8 hemagglutinin
gggagaaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215464 - RNA, 1930 nt, Artificial Sequence
  mRNA product opt Design1 from Influenza A H5N8 hemagglutinin
gggagaaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215465 - RNA, 1927 nt, Artificial Sequence
  mRNA product opt Design1 from Influenza A H5N8 hemagglutinin
gggagaaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215466 - RNA, 1924 nt, Artificial Sequence
  mRNA product opt Design1 from Influenza A H5N8 hemagglutinin
gggagaaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215467 - RNA, 1924 nt, Artificial Sequence
  mRNA product opt Design1 from Influenza A H5N8 hemagglutinin
gggagaaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215468 - RNA, 1924 nt, Artificial Sequence
  mRNA product opt Design1 from Influenza A H5N8 hemagglutinin
gggagaaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215469 - RNA, 1945 nt, Artificial Sequence
  mRNA product opt Design1 from Influenza A H5N8 hemagglutinin
gggagaaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215470 - RNA, 1933 nt, Artificial Sequence
  mRNA product opt Design1 from Influenza A H5N8 hemagglutinin
gggagaaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215471 - RNA, 1924 nt, Artificial Sequence
  mRNA product opt Design1 from Influenza A H5N8 hemagglutinin
gggagaaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215472 - RNA, 1942 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215473 - RNA, 1936 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215474 - RNA, 1939 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215475 - RNA, 1954 nt, Artificial Sequence
  mRNA product opt Design1 from Influenza A H5N8 hemagglutinin
gggagaaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215476 - RNA, 1930 nt, Artificial Sequence
  mRNA product opt Design1 from Influenza A H5N8 hemagglutinin
gggagaaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215477 - RNA, 1930 nt, Artificial Sequence
  mRNA product opt Design1 from Influenza A H5N8 hemagglutinin
gggagaaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215478 - RNA, 1930 nt, Artificial Sequence
  mRNA product opt Design1 from Influenza A H5N8 hemagglutinin
gggagaaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215479 - RNA, 1936 nt, Artificial Sequence
  mRNA product opt Design1 from Influenza A H5N8 hemagglutinin
gggagaaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215480 - RNA, 1951 nt, Artificial Sequence
  mRNA product opt Design1 from Influenza A H5N8 hemagglutinin
gggagaaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215481 - RNA, 1936 nt, Artificial Sequence
  mRNA product opt Design1 from Influenza A H5N8 hemagglutinin
gggagaaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215482 - RNA, 1933 nt, Artificial Sequence
  mRNA product opt Design1 from Influenza A H5N8 hemagglutinin
gggagaaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215483 - RNA, 1948 nt, Artificial Sequence
  mRNA product opt Design1 from Influenza A H5N8 hemagglutinin
gggagaaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215484 - RNA, 2092 nt, Artificial Sequence
  mRNA product opt Design2 from Influenza A H5N8 hemagglutinin
ggggcgcugccuacggagguggcagccaucuccuucucggcaucaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215485 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215486 - RNA, 2110 nt, Artificial Sequence
  mRNA product opt Design2 from Influenza A H5N8 hemagglutinin
ggggcgcugccuacggagguggcagccaucuccuucucggcaucaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215487 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215488 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215489 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215490 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215491 - RNA, 2086 nt, Artificial Sequence
  mRNA product opt Design2 from Influenza A H5N8 hemagglutinin
ggggcgcugccuacggagguggcagccaucuccuucucggcaucaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215492 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215493 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215494 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215495 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215496 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215497 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215498 - RNA, 2098 nt, Artificial Sequence
  mRNA product opt Design2 from Influenza A H5N8 hemagglutinin
ggggcgcugccuacggagguggcagccaucuccuucucggcaucaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215499 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215500 - RNA, 2107 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215501 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215502 - RNA, 2104 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215503 - RNA, 2119 nt, Artificial Sequence
  mRNA product opt Design2 from Influenza A H5N8 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215504 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215505 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215506 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215507 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215508 - RNA, 2116 nt, Artificial Sequence
  mRNA product opt Design2 from Influenza A H5N8 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215509 - RNA, 2101 nt, Artificial Sequence
  mRNA product opt Design2 from Influenza A H5N8 hemagglutinin
ggggcgcugccuacggagguggcagccaucuccuucucggcaucaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215510 - RNA, 2098 nt, Artificial Sequence
  mRNA product opt Design2 from Influenza A H5N8 hemagglutinin
ggggcgcugccuacggagguggcagccaucuccuucucggcaucaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215511 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagagcgugcgcaacgggacguacgacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215512 - protein, 567 aa, Artificial Sequence
  Influenza A H5N8 hemagglutinin
MENIVLLLAIVSLVKSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215513 - RNA, 1704 nt, Artificial Sequence
  Influenza A H5N8 hemagglutinin
auggagaacauagugcuucuucuugcaauaguuagccuuguuaaaagugaucagauuugcauugguuaccaugcaaacaacucgacagagcaaguugacacgauaauggaaaagaacgucacuguuacacaugcccaagacauacuggaaaaaacacacaacgggaagcucugcgaucuaaauggggugaagccucugauuuuaaaggauuguaguguagcuggauggcuccucggaaacccaaugugcgacgaauucaucagagugccggaauggucuuacauaguggagagggcuaauccagcuaaugaccucuguuacccagggagccucaauaacuaugaagaacugaaacaccuguugagcagaauaaaucauuuugagaagauucugaucauccccaagaguucuuggcccaaucaugaaacaucauuaggggugagcgcagccuguccguaccagggaacgcccuccuuuuucagaaaugugguauggcuuaucaaaaagaacgaugcauacccaacaauaaagauaagcuacaauaauaccaaucgggaagaucucuugauacuguggggaauucaucauuccaacaaugcagaagagcagacaaaucucuauaaaaacccaaccaccuauauuucaguuggaacaucaacauuaaaccagagauugguaccaaaaauagcuacuagaucccaaguaaacgggcaacguggaagaauggacuucuucuggacaauuuuaaaaccgaaugaugcaauccauuucgagaguaauggaaauuucauugcuccagaauaugcauacaaaauugucaagaaaggggacucaacaauuaugaaaaguggaguggaauauggccacugcaacaccaaaugucaaaccccaguaggagcgauaaacucuaguaugccguuccacaauauacauccucucaccaucggggaaugccccaaauacgugaagucaaacaaguugguccuugcgacugggcucagaaauaguccucuaagagaaaagagaagaaagagagggcuguuuggagcuauagcagguuuuauagagggaggauggcagggaaugguugaugguugguauggguaccaccauagcaaugagcaggggaguggguacgcugcagacaaagaauccacccaaaaggcaauagauggaguuaccaauaaggucaacucgaucauugacaaaaugaacacucaauuugaggcaguuggaagggaguuuaauaacuuagaaaggaggauagagaauuugaacaagaaaauggaagacggauuccuagaugucuggaccuauaaugcugaacuucuaguucucauggaaaacgagaggacucuagauuuccaugacucaaaugucaagaaccuuuacgacaaagucagacugcagcuuagggauaaugcaaaggagcuggguaacgguuguuucgaauucuaucacaaaugugauaaugaauguauggaaagugugagaaaugggacguauuacuacccucaguauucagaagaagcaagauuaaaaagagaagaaauaagcggagugaaauuagaaucaauaggaacuuaccaaauacugucaauuuauucaacaguggcgaguucccuagcacuggcaaucaugguggcuggucuaucuuuauggaugugcuccaaugggucguuacagugcagaauuugcauuuaa

SEQ ID NO: 215514 - RNA, 1704 nt, Artificial Sequence
  derived and/or modified sequence opt from Influenza A H5N8 hemagglutinin
auggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215515 - RNA, 1921 nt, Artificial Sequence
  mRNA product opt Design1 from Influenza A H5N8 hemagglutinin
gggagaaagcuuaccauggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215516 - RNA, 2086 nt, Artificial Sequence
  R5820 mRNA product opt Design2 from Influenza A H5N8 hemagglutinin
ggggcgcugccuacggagguggcagccaucuccuucucggcaucaagcuuaccauggagaacaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215517 - protein, 569 aa, Artificial Sequence
  derived and/or modified sequence from Influenza A H5N8 hemagglutinin
MKWVTFISLLFLFSSAYSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215518 - protein, 569 aa, Artificial Sequence
  derived and/or modified sequence from Influenza A H5N8 hemagglutinin
MDWTWILFLVAAATRVHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215519 - protein, 575 aa, Artificial Sequence
  derived and/or modified sequence from Influenza A H5N8 hemagglutinin
MPMGSLQPLATLYLLGMLVASCLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215520 - protein, 575 aa, Artificial Sequence
  derived and/or modified sequence from Influenza A H5N8 hemagglutinin
MAVMAPRTLVLLLSGALALTQTWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215521 - protein, 576 aa, Artificial Sequence
  derived and/or modified sequence from Influenza A H5N8 hemagglutinin
MAVMAPRTLVLLLSGALALTQTWAGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215522 - protein, 575 aa, Artificial Sequence
  derived and/or modified sequence from Influenza A H5N8 hemagglutinin
MASSLYSFLLALSIVYIFVAPTHSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215523 - protein, 570 aa, Artificial Sequence
  derived and/or modified sequence from Influenza A H5N8 hemagglutinin
MTRLTVLALLAGLLASSRADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215524 - protein, 567 aa, Artificial Sequence
  derived and/or modified sequence from Influenza A H5N8 hemagglutinin
MPLLLLLPLLWAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215525 - protein, 570 aa, Artificial Sequence
  derived and/or modified sequence from Influenza A H5N8 hemagglutinin
MIKLKFGVFFTVLLSSAYADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215526 - protein, 569 aa, Artificial Sequence
  derived and/or modified sequence from Influenza A H5N8 hemagglutinin
MAFLWLLSCWALLGTTFGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215527 - protein, 568 aa, Artificial Sequence
  derived and/or modified sequence from Influenza A H5N8 hemagglutinin
MGVKVLFALICIAVAEADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215528 - protein, 568 aa, Artificial Sequence; identical to SEQ ID NO: 215527
  derived and/or modified sequence from Influenza A H5N8 hemagglutinin

SEQ ID NO: 215529 - protein, 568 aa, Artificial Sequence
  derived and/or modified sequence from Influenza A H5N8 hemagglutinin
MKAILVVLLYTFATANADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215530 - protein, 575 aa, Artificial Sequence
  derived and/or modified sequence from Influenza A H5N8 hemagglutinin
MALWMRLLPLLALLALWGPDPAAADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215531 - protein, 571 aa, Artificial Sequence
  derived and/or modified sequence from Influenza A H5N8 hemagglutinin
MYRMQLLSCIALSLALVTNSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215532 - protein, 568 aa, Artificial Sequence
  derived and/or modified sequence from Influenza A H5N8 hemagglutinin
MRAWIFFLLCLAGRALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215533 - protein, 574 aa, Artificial Sequence
  derived and/or modified sequence from Influenza A H5N8 hemagglutinin
MDAMKRGLCCVLLLCGAVFVSPSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215534 - protein, 572 aa, Artificial Sequence
  derived and/or modified sequence from Influenza A H5N8 hemagglutinin
MDAMKRGLCCVLLLCGAVFVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215535 - protein, 573 aa, Artificial Sequence
  derived and/or modified sequence from Influenza A H5N8 hemagglutinin
MDAMKRGLCCVLLLCGAVFVSPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215536 - protein, 578 aa, Artificial Sequence
  derived and/or modified sequence from Influenza A H5N8 hemagglutinin
MGVHECPAWLWLLLSLLSLPLGLPVLGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215537 - protein, 570 aa, Artificial Sequence
  derived and/or modified sequence from Influenza A H5N8 hemagglutinin
MEFGLSWVFLVALFRGVQCDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215538 - protein, 570 aa, Artificial Sequence
  derived and/or modified sequence from Influenza A H5N8 hemagglutinin
MDWTWRVFCLLAVTPGAHPDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215539 - protein, 570 aa, Artificial Sequence
  derived and/or modified sequence from Influenza A H5N8 hemagglutinin
MAWSPLFLTLITHCAGSWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215540 - protein, 572 aa, Artificial Sequence
  derived and/or modified sequence from Influenza A H5N8 hemagglutinin
METDTLLLWVLLLWVPGSTGDDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215541 - protein, 577 aa, Artificial Sequence
  derived and/or modified sequence from Influenza A H5N8 hemagglutinin
MKTHYSSAILPILTLFVFLSINPSHGDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215542 - protein, 572 aa, Artificial Sequence
  derived and/or modified sequence from Influenza A H5N8 hemagglutinin
MGMRMMFIMFMLVVLATTVVSDQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215543 - protein, 571 aa, Artificial Sequence
  derived and/or modified sequence from Influenza A H5N8 hemagglutinin
MARPLCTLLLLMATLAGALADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215544 - protein, 576 aa, Artificial Sequence
  derived and/or modified sequence from Influenza A H5N8 hemagglutinin
MAISGVPVLGFFIIAVLMSAQESWADQICIGYHANNSTEQVDTIMEKNVTVTHAQDILEKTHNGKLCDLNGVKPLILKDCSVAGWLLGNPMCDEFIRVPEWSYIVERANPANDLCYPGSLNNYEELKHLLSRINHFEKILIIPKSSWPNHETSLGVSAACPYQGTPSFFRNVVWLIKKNDAYPTIKISYNNTNREDLLILWGIHHSNNAEEQTNLYKNPTTYISVGTSTLNQRLVPKIATRSQVNGQRGRMDFFWTILKPNDAIHFESNGNFIAPEYAYKIVKKGDSTIMKSGVEYGHCNTKCQTPVGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYYYPQYSEEARLKREEISGVKLESIGTYQILSIYSTVASSLALAIMVAGLSLWMCSNGSLQCRICI

SEQ ID NO: 215545 - RNA, 1710 nt, Artificial Sequence
  derived and/or modified sequence opt from Influenza A H5N8 hemagglutinin
augaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215546 - RNA, 1710 nt, Artificial Sequence
  derived and/or modified sequence opt from Influenza A H5N8 hemagglutinin
auggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215547 - RNA, 1728 nt, Artificial Sequence
  derived and/or modified sequence opt from Influenza A H5N8 hemagglutinin
augcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215548 - RNA, 1728 nt, Artificial Sequence
  derived and/or modified sequence opt from Influenza A H5N8 hemagglutinin
auggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215549 - RNA, 1731 nt, Artificial Sequence
  derived and/or modified sequence opt from Influenza A H5N8 hemagglutinin
auggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215550 - RNA, 1728 nt, Artificial Sequence
  derived and/or modified sequence opt from Influenza A H5N8 hemagglutinin
auggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215551 - RNA, 1713 nt, Artificial Sequence
  derived and/or modified sequence opt from Influenza A H5N8 hemagglutinin
augacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215552 - RNA, 1704 nt, Artificial Sequence
  derived and/or modified sequence opt from Influenza A H5N8 hemagglutinin
augccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215553 - RNA, 1713 nt, Artificial Sequence
  derived and/or modified sequence opt from Influenza A H5N8 hemagglutinin
augaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215554 - RNA, 1710 nt, Artificial Sequence
  derived and/or modified sequence opt from Influenza A H5N8 hemagglutinin
auggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215555 - RNA, 1707 nt, Artificial Sequence
  derived and/or modified sequence opt from Influenza A H5N8 hemagglutinin
augggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215556 - RNA, 1707 nt, Artificial Sequence
  derived and/or modified sequence opt from Influenza A H5N8 hemagglutinin
augggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215557 - RNA, 1707 nt, Artificial Sequence
  derived and/or modified sequence opt from Influenza A H5N8 hemagglutinin
augaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215558 - RNA, 1728 nt, Artificial Sequence
  derived and/or modified sequence opt from Influenza A H5N8 hemagglutinin
auggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215559 - RNA, 1716 nt, Artificial Sequence
  derived and/or modified sequence opt from Influenza A H5N8 hemagglutinin
auguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215560 - RNA, 1707 nt, Artificial Sequence
  derived and/or modified sequence opt from Influenza A H5N8 hemagglutinin
augcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215561 - RNA, 1725 nt, Artificial Sequence
  derived and/or modified sequence opt from Influenza A H5N8 hemagglutinin
auggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215562 - RNA, 1719 nt, Artificial Sequence
  derived and/or modified sequence opt from Influenza A H5N8 hemagglutinin
auggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215563 - RNA, 1722 nt, Artificial Sequence
  derived and/or modified sequence opt from Influenza A H5N8 hemagglutinin
auggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215564 - RNA, 1737 nt, Artificial Sequence
  derived and/or modified sequence opt from Influenza A H5N8 hemagglutinin
augggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215565 - RNA, 1713 nt, Artificial Sequence
  derived and/or modified sequence opt from Influenza A H5N8 hemagglutinin
auggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215566 - RNA, 1713 nt, Artificial Sequence
  derived and/or modified sequence opt from Influenza A H5N8 hemagglutinin
auggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215567 - RNA, 1713 nt, Artificial Sequence
  derived and/or modified sequence opt from Influenza A H5N8 hemagglutinin
auggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215568 - RNA, 1719 nt, Artificial Sequence
  derived and/or modified sequence opt from Influenza A H5N8 hemagglutinin
auggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215569 - RNA, 1734 nt, Artificial Sequence
  derived and/or modified sequence opt from Influenza A H5N8 hemagglutinin
augaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215570 - RNA, 1719 nt, Artificial Sequence
  derived and/or modified sequence opt from Influenza A H5N8 hemagglutinin
augggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215571 - RNA, 1716 nt, Artificial Sequence
  derived and/or modified sequence opt from Influenza A H5N8 hemagglutinin
auggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215572 - RNA, 1731 nt, Artificial Sequence
  derived and/or modified sequence opt from Influenza A H5N8 hemagglutinin
auggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucuga

SEQ ID NO: 215573 - RNA, 1927 nt, Artificial Sequence
  mRNA product opt Design1 from Influenza A H5N8 hemagglutinin
gggagaaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215574 - RNA, 1927 nt, Artificial Sequence
  mRNA product opt Design1 from Influenza A H5N8 hemagglutinin
gggagaaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215575 - RNA, 1945 nt, Artificial Sequence
  mRNA product opt Design1 from Influenza A H5N8 hemagglutinin
gggagaaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215576 - RNA, 1945 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215577 - RNA, 1948 nt, Artificial Sequence
  mRNA product opt Design1 from Influenza A H5N8 hemagglutinin
gggagaaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215578 - RNA, 1945 nt, Artificial Sequence
  mRNA product opt Design1 from Influenza A H5N8 hemagglutinin
gggagaaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215579 - RNA, 1930 nt, Artificial Sequence
  mRNA product opt Design1 from Influenza A H5N8 hemagglutinin
gggagaaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215580 - RNA, 1921 nt, Artificial Sequence
  mRNA product opt Design1 from Influenza A H5N8 hemagglutinin
gggagaaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215581 - RNA, 1930 nt, Artificial Sequence
  mRNA product opt Design1 from Influenza A H5N8 hemagglutinin
gggagaaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215582 - RNA, 1927 nt, Artificial Sequence
  mRNA product opt Design1 from Influenza A H5N8 hemagglutinin
gggagaaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215583 - RNA, 1924 nt, Artificial Sequence
  mRNA product opt Design1 from Influenza A H5N8 hemagglutinin
gggagaaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215584 - RNA, 1924 nt, Artificial Sequence
  mRNA product opt Design1 from Influenza A H5N8 hemagglutinin
gggagaaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215585 - RNA, 1924 nt, Artificial Sequence
  mRNA product opt Design1 from Influenza A H5N8 hemagglutinin
gggagaaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215586 - RNA, 1945 nt, Artificial Sequence
  mRNA product opt Design1 from Influenza A H5N8 hemagglutinin
gggagaaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215587 - RNA, 1933 nt, Artificial Sequence
  mRNA product opt Design1 from Influenza A H5N8 hemagglutinin
gggagaaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215588 - RNA, 1924 nt, Artificial Sequence
  mRNA product opt Design1 from Influenza A H5N8 hemagglutinin
gggagaaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215589 - RNA, 1942 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215590 - RNA, 1936 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215591 - RNA, 1939 nt, Artificial Sequence
  mRNA product opt Design1 from Influenza A H5N8 hemagglutinin
gggagaaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215592 - RNA, 1954 nt, Artificial Sequence
  mRNA product opt Design1 from Influenza A H5N8 hemagglutinin
gggagaaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215593 - RNA, 1930 nt, Artificial Sequence
  mRNA product opt Design1 from Influenza A H5N8 hemagglutinin
gggagaaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215594 - RNA, 1930 nt, Artificial Sequence
  mRNA product opt Design1 from Influenza A H5N8 hemagglutinin
gggagaaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215595 - RNA, 1930 nt, Artificial Sequence
  mRNA product opt Design1 from Influenza A H5N8 hemagglutinin
gggagaaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215596 - RNA, 1936 nt, Artificial Sequence
  mRNA product opt Design1 from Influenza A H5N8 hemagglutinin
gggagaaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215597 - RNA, 1951 nt, Artificial Sequence
  mRNA product opt Design1 from Influenza A H5N8 hemagglutinin
gggagaaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215598 - RNA, 1936 nt, Artificial Sequence
  mRNA product opt Design1 from Influenza A H5N8 hemagglutinin
gggagaaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215599 - RNA, 1933 nt, Artificial Sequence
  mRNA product opt Design1 from Influenza A H5N8 hemagglutinin
gggagaaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215600 - RNA, 1948 nt, Artificial Sequence
  mRNA product opt Design1 from Influenza A H5N8 hemagglutinin
gggagaaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215601 - RNA, 2092 nt, Artificial Sequence
  mRNA product opt Design2 from Influenza A H5N8 hemagglutinin
ggggcgcugccuacggagguggcagccaucuccuucucggcaucaagcuuaccaugaagugggugaccuucaucagccugcucuuccuguucuccagcgccuacuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215602 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggacuggaccuggauccuguuccucguggccgccgcgacccgcguccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215603 - RNA, 2110 nt, Artificial Sequence
  mRNA product opt Design2 from Influenza A H5N8 hemagglutinin
ggggcgcugccuacggagguggcagccaucuccuucucggcaucaagcuuaccaugcccaugggcagccugcagccgcucgccacccuguaccugcucgggaugcugguggccuccugccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215604 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215605 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccgugauggccccgcggacccugguccuccugcugagcggcgcgcucgcccugacccagacgugggccggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215606 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggccagcucccuguacagcuuccuccuggcccuguccaucguguacaucuucgucgcgcccacccacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215607 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugacccgccugaccgugcucgcccugcuggccggccuccuggcgagcucccgggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215608 - RNA, 2086 nt, Artificial Sequence
  mRNA product opt Design2 from Influenza A H5N8 hemagglutinin
ggggcgcugccuacggagguggcagccaucuccuucucggcaucaagcuuaccaugccccugcuccugcugcucccgcugcugugggccggcgcccucgcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215609 - RNA, 2095 nt, Artificial Sequence
  mRNA product opt Design2 from Influenza A H5N8 hemagglutinin
ggggcgcugccuacggagguggcagccaucuccuucucggcaucaagcuuaccaugaucaagcugaaguucggcguguucuucaccguccuccugagcuccgccuacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215610 - RNA, 2092 nt, Artificial Sequence
  mRNA product opt Design2 from Influenza A H5N8 hemagglutinin
ggggcgcugccuacggagguggcagccaucuccuucucggcaucaagcuuaccauggccuuccuguggcuccugagcugcugggcccugcucggcaccaccuucggggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215611 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggagugaaaguucuuuuugcccuuauuuguauugcuguggccgaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215612 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugggcgugaagguccuguucgcccucaucugcaucgccguggcggaggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215613 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugaaggccauccuggugguccuccuguacaccuucgccaccgcgaacgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215614 - RNA, 2110 nt, Artificial Sequence
  mRNA product opt Design2 from Influenza A H5N8 hemagglutinin
ggggcgcugccuacggagguggcagccaucuccuucucggcaucaagcuuaccauggcccuguggaugcgccuccugccccugcucgcccugcuggcgcucuggggcccggaccccgccgccgccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215615 - RNA, 2098 nt, Artificial Sequence
  mRNA product opt Design2 from Influenza A H5N8 hemagglutinin
ggggcgcugccuacggagguggcagccaucuccuucucggcaucaagcuuaccauguaccggaugcagcugcucagcugcaucgcccugucgcuggcgcucgugaccaacagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215616 - RNA, 2089 nt, Artificial Sequence
  mRNA product opt Design2 from Influenza A H5N8 hemagglutinin
ggggcgcugccuacggagguggcagccaucuccuucucggcaucaagcuuaccaugcgcgccuggaucuucuuccugcucugccuggccggccgggcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215617 - RNA, 2107 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccuccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215618 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215619 - RNA, 2104 nt, Artificial Sequence
  mRNA product opt Design2 from Influenza A H5N8 hemagglutinin
ggggcgcugccuacggagguggcagccaucuccuucucggcaucaagcuuaccauggacgccaugaagcgcggccugugcugcgugcuccugcugugcggggccgucuucgugagccccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215620 - RNA, 2119 nt, Artificial Sequence
  mRNA product opt Design2 from Influenza A H5N8 hemagglutinin
ggggcgcugccuacggagguggcagccaucuccuucucggcaucaagcuuaccaugggcgugcacgagugccccgccuggcuguggcuccugcugagccuccugucccugccgcucgggcugcccguccugggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215621 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggaguucggccugagcuggguguuccucgucgcccuguuccgcggggugcagugcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215622 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggacuggaccuggcgcguguucugccugcucgccgucacccccggcgcccacccggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215623 - RNA, 2095 nt, Artificial Sequence
  mRNA product opt Design2 from Influenza A H5N8 hemagglutinin
ggggcgcugccuacggagguggcagccaucuccuucucggcaucaagcuuaccauggccuggagcccccuguuccucacccugaucacccacugcgccggcuccugggcggaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215624 - RNA, 2101 nt, Artificial Sequence
  mRNA product opt Design2 from Influenza A H5N8 hemagglutinin
ggggcgcugccuacggagguggcagccaucuccuucucggcaucaagcuuaccauggagaccgacacccugcuccugugggugcugcuccuguggguccccggcagcacgggggacgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215625 - RNA, 2116 nt, Artificial Sequence
  mRNA product opt Design2 from Influenza A H5N8 hemagglutinin
ggggcgcugccuacggagguggcagccaucuccuucucggcaucaagcuuaccaugaagacccacuacagcuccgccauccugcccauccucacccuguucguguuccugagcaucaacccgucccacggcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215626 - RNA, 2101 nt, Artificial Sequence
  mRNA product opt Design2 from Influenza A H5N8 hemagglutinin
ggggcgcugccuacggagguggcagccaucuccuucucggcaucaagcuuaccaugggcaugcgcaugauguucaucauguucaugcuggugguccucgccaccaccguggugagcgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215627 - RNA, 2098 nt, Artificial Sequence
  mRNA product opt Design2 from Influenza A H5N8 hemagglutinin
ggggcgcugccuacggagguggcagccaucuccuucucggcaucaagcuuaccauggcccgcccccugugcacccuccugcugcucauggccacccuggcgggcgcccuggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215628 - RNA, 2113 nt, Artificial Sequence
  mRNA product opt Design2 from Influenza A H5N8 hemagglutinin
ggggcgcugccuacggagguggcagccaucuccuucucggcaucaagcuuaccauggccaucagcggcgugcccguccugggguucuucaucaucgccgugcucauguccgcgcaggagagcugggccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugagccgcaucaaccacuucgagaagauccugaucaucccgaaguccagcuggcccaaccacgagaccucccugggcgucagcgccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacagcagcaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucagcggcgucaagcuggaguccaucgggaccuaccagauccugagcaucuacuccaccguggccagcucccucgcgcuggccaucaugguggccggccugagccucuggaugugcuccaacgggagccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215629 - RNA, 1701 nt, Artificial Sequence
  derived and/or modified sequence opt from Influenza A H1N1 hemagglutinin
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaguucucgcuauuccaagaaauuuaagccagagauugcaauccgacccaaagugcgugaucaggagggaagaaugaauuacuauuggacucugguggaaccuggugacaagauuaccuucgaggccacaggcaaccuagucguuccaagguacgcuuuugccauggaacggaacgcagggagcggaaucauaauuucggauacuccggugcaugacugcaauaccacaugucaaacccccaaaggcgcuaucaacacgucucucccuuuccagaauauucacccaaucacuaucgguaagugccccaaguauguaaaauccacaaagcugcgccuugccaccgggcugagaaacauuccuucaauacagaguaggggauuguuuggcgcgaucgccggcuucauugaggggggauggacugguaugguggacggcugguacggguaucaucaccagaaugaacaaggaagcggcuacgcagcugaucucaaauccacacagaacgccaucgacgagauaaccaauaaggucaacucugugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauagcaaugugaaaaaccuguacgagaagguacgaucacagcucaaaaacaaugcaaaggaaauuggcaacggauguuuugaguucuaucacaagugcgacaauaccuguauggaaaguguuaaaaacggcacauacgauuauccaaaguacuccgaggaagccaagcugaauagagaggagaucgacggggugaaacuugaaagcacuaggauuuaucaaauacuggcuaucuacucuaccgucgcgucaaguuuggugcucgucgugagccugggagcaauuuccuuuuggaugugcucuaacgguucguuacagugccggaucuguaucuga

SEQ ID NO: 215630 - RNA, 1918 nt, Artificial Sequence
  R5934 mRNA product opt Design1 from Influenza A H1N1 hemagglutinin
gggagaaagcuuaccaugaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaguucucgcuauuccaagaaauuuaagccagagauugcaauccgacccaaagugcgugaucaggagggaagaaugaauuacuauuggacucugguggaaccuggugacaagauuaccuucgaggccacaggcaaccuagucguuccaagguacgcuuuugccauggaacggaacgcagggagcggaaucauaauuucggauacuccggugcaugacugcaauaccacaugucaaacccccaaaggcgcuaucaacacgucucucccuuuccagaauauucacccaaucacuaucgguaagugccccaaguauguaaaauccacaaagcugcgccuugccaccgggcugagaaacauuccuucaauacagaguaggggauuguuuggcgcgaucgccggcuucauugaggggggauggacugguaugguggacggcugguacggguaucaucaccagaaugaacaaggaagcggcuacgcagcugaucucaaauccacacagaacgccaucgacgagauaaccaauaaggucaacucugugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauagcaaugugaaaaaccuguacgagaagguacgaucacagcucaaaaacaaugcaaaggaaauuggcaacggauguuuugaguucuaucacaagugcgacaauaccuguauggaaaguguuaaaaacggcacauacgauuauccaaaguacuccgaggaagccaagcugaauagagaggagaucgacggggugaaacuugaaagcacuaggauuuaucaaauacuggcuaucuacucuaccgucgcgucaaguuuggugcucgucgugagccugggagcaauuuccuuuuggaugugcucuaacgguucguuacagugccggaucuguaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215631 - RNA, 2083 nt, Artificial Sequence
  mRNA product opt Design2 from Influenza A H1N1 hemagglutinin
ggggcgcugccuacggagguggcagccaucuccuucucggcaucaagcuuaccaugaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaagagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaguucucgcuauuccaagaaauuuaagccagagauugcaauccgacccaaagugcgugaucaggagggaagaaugaauuacuauuggacucugguggaaccuggugacaagauuaccuucgaggccacaggcaaccuagucguuccaagguacgcuuuugccauggaacggaacgcagggagcggaaucauaauuucggauacuccggugcaugacugcaauaccacaugucaaacccccaaaggcgcuaucaacacgucucucccuuuccagaauauucacccaaucacuaucgguaagugccccaaguauguaaaauccacaaagcugcgccuugccaccgggcugagaaacauuccuucaauacagaguaggggauuguuuggcgcgaucgccggcuucauugaggggggauggacugguaugguggacggcugguacggguaucaucaccagaaugaacaaggaagcggcuacgcagcugaucucaaauccacacagaacgccaucgacgagauaaccaauaaggucaacucugugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauagcaaugugaaaaaccuguacgagaagguacgaucacagcucaaaaacaaugcaaaggaaauuggcaacggauguuuugaguucuaucacaagugcgacaauaccuguauggaaaguguuaaaaacggcacauacgauuauccaaaguacuccgaggaagccaagcugaauagagaggagaucgacggggugaaacuugaaagcacuaggauuuaucaaauacuggcuaucuacucuaccgucgcgucaaguuuggugcucgucgugagccugggagcaauuuccuuuuggaugugcucuaacgguucguuacagugccggaucuguaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215632 - RNA, 1758 nt, Artificial Sequence
  derived and/or modified sequence opt from Influenza B hemagglutinin
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccaaaaaacgacaagaauaaaaccgccacgaacccgcucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgugauaacgucagcuguucuaucugccuguga

SEQ ID NO: 215633 - RNA, 1975 nt, Artificial Sequence
  R5935 mRNA product opt Design1 from Influenza B hemagglutinin
gggagaaagcuuaccaugaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccaaaaaacgacaagaauaaaaccgccacgaacccgcucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgugauaacgucagcuguucuaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215634 - RNA, 2140 nt, Artificial Sequence
  mRNA product opt Design2 from Influenza B hemagglutinin
ggggcgcugccuacggagguggcagccaucuccuucucggcaucaagcuuaccaugaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccaaaaaacgacaagaauaaaaccgccacgaacccgcucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgugauaacgucagcuguucuaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215635 - RNA, 1497 nt, Artificial Sequence
  derived and/or modified sequence opt from Influenza A H1N1 nucleocapsid protein
auggccagccagggcaccaagagauccuacgagcaaauggaaacagacggggagaggcagaacgcuacugaaauccgggcaucugugggaaaaaugauugguggcauagggcgcuucuauauccagaugugcacggagcugaagcucucagauuacgaaggacgacuuauucagaauagucugaccaucgagcguauggucuugagcgccuuugacgagagaaggaacaaauauuuagaagagcaccccuccgcgggcaaggauccuaaaaagacaggugggccaauuuaccggcgcguuaauggaaaguggaugagagaacugauccuauaugacaaagaggagauaaggcggaucuggcgccaagcuaacaauggcgaugacgccacugcaggccucacccauaugaugauuuggcacucuaaccugaaugaugccacauaccagcgaaccagagcucuugugaggacugggauggacccgcggauguguucgcugaugcagggaucaacauugccccgucgcagcggugcagccggcgcugccguaaagggggugggaaccauggucauggaacucgugagaaugaucaaaaggggcauuaacgaucggaauuucuggcgaggugagaacgggcgcaagacgagaaucgcguaugaaaggaugugcaauauacugaaaggaaaguuucagacugcagcccaaaaggcuaugauggaccagguucgggagagucgcaacccuggcaaugccgaguucgaagaucugaccuuucucgcaagauccgcuuuaauucugaggggcucuguggcccauaaaagcugucuuccagcgugcgucuacgggcccgccguggcauccggauacgacuucgagcgugaagguuauucauugguaggcaucgauccuuuucggcugcuacagaacagucagguuuacagccucauucgaccaaaugagaaccccgcucacaagucucaacugguguggauggccugucauuccgcugccuucgaagaccuuagaguccugucauuuaucaaagggacaaagguguugccuaggggaaaacucagcacucgcggcgugcagaucgcaaguaacgagaauauggaaaccauggagucuuccacacuggaguuacggagcagauauugggccauuaggacccgcucgggugggaacacgaaucagcaacgagcuucugcgggccagauauccauccagccaacuuucucaguccagcggaaccugccguuugaccguacaaccauuauggcagccuucaauggaaacacugaaggcagaacaagugauaugaggaccgagaucauacgcaugauggaaagcgcucggcccgaggacguuuccuuucaagggagaggaguguucgaacucucugaugagaaggccgcaagcccuauuguaccaucauucgacaugaguaaugaggguuccuacuuuuucggcgauaacgccgaagaguaugacaauuga

SEQ ID NO: 215636 - RNA, 1714 nt, Artificial Sequence
  R5936 mRNA product opt Design1 from Influenza A H1N1 nucleocapsid protein
gggagaaagcuuaccauggccagccagggcaccaagagauccuacgagcaaauggaaacagacggggagaggcagaacgcuacugaaauccgggcaucugugggaaaaaugauugguggcauagggcgcuucuauauccagaugugcacggagcugaagcucucagauuacgaaggacgacuuauucagaauagucugaccaucgagcguauggucuugagcgccuuugacgagagaaggaacaaauauuuagaagagcaccccuccgcgggcaaggauccuaaaaagacaggugggccaauuuaccggcgcguuaauggaaaguggaugagagaacugauccuauaugacaaagaggagauaaggcggaucuggcgccaagcuaacaauggcgaugacgccacugcaggccucacccauaugaugauuuggcacucuaaccugaaugaugccacauaccagcgaaccagagcucuugugaggacugggauggacccgcggauguguucgcugaugcagggaucaacauugccccgucgcagcggugcagccggcgcugccguaaagggggugggaaccauggucauggaacucgugagaaugaucaaaaggggcauuaacgaucggaauuucuggcgaggugagaacgggcgcaagacgagaaucgcguaugaaaggaugugcaauauacugaaaggaaaguuucagacugcagcccaaaaggcuaugauggaccagguucgggagagucgcaacccuggcaaugccgaguucgaagaucugaccuuucucgcaagauccgcuuuaauucugaggggcucuguggcccauaaaagcugucuuccagcgugcgucuacgggcccgccguggcauccggauacgacuucgagcgugaagguuauucauugguaggcaucgauccuuuucggcugcuacagaacagucagguuuacagccucauucgaccaaaugagaaccccgcucacaagucucaacugguguggauggccugucauuccgcugccuucgaagaccuuagaguccugucauuuaucaaagggacaaagguguugccuaggggaaaacucagcacucgcggcgugcagaucgcaaguaacgagaauauggaaaccauggagucuuccacacuggaguuacggagcagauauugggccauuaggacccgcucgggugggaacacgaaucagcaacgagcuucugcgggccagauauccauccagccaacuuucucaguccagcggaaccugccguuugaccguacaaccauuauggcagccuucaauggaaacacugaaggcagaacaagugauaugaggaccgagaucauacgcaugauggaaagcgcucggcccgaggacguuuccuuucaagggagaggaguguucgaacucucugaugagaaggccgcaagcccuauuguaccaucauucgacaugaguaaugaggguuccuacuuuuucggcgauaacgccgaagaguaugacaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215637 - RNA, 1879 nt, Artificial Sequence
  mRNA product opt Design2 from Influenza A H1N1 nucleocapsid protein
ggggcgcugccuacggagguggcagccaucuccuucucggcaucaagcuuaccauggccagccagggcaccaagagauccuacgagcaaauggaaacagacggggagaggcagaacgcuacugaaauccgggcaucugugggaaaaaugauugguggcauagggcgcuucuauauccagaugugcacggagcugaagcucucagauuacgaaggacgacuuauucagaauagucugaccaucgagcguauggucuugagcgccuuugacgagagaaggaacaaauauuuagaagagcaccccuccgcgggcaaggauccuaaaaagacaggugggccaauuuaccggcgcguuaauggaaaguggaugagagaacugauccuauaugacaaagaggagauaaggcggaucuggcgccaagcuaacaauggcgaugacgccacugcaggccucacccauaugaugauuuggcacucuaaccugaaugaugccacauaccagcgaaccagagcucuugugaggacugggauggacccgcggauguguucgcugaugcagggaucaacauugccccgucgcagcggugcagccggcgcugccguaaagggggugggaaccauggucauggaacucgugagaaugaucaaaaggggcauuaacgaucggaauuucuggcgaggugagaacgggcgcaagacgagaaucgcguaugaaaggaugugcaauauacugaaaggaaaguuucagacugcagcccaaaaggcuaugauggaccagguucgggagagucgcaacccuggcaaugccgaguucgaagaucugaccuuucucgcaagauccgcuuuaauucugaggggcucuguggcccauaaaagcugucuuccagcgugcgucuacgggcccgccguggcauccggauacgacuucgagcgugaagguuauucauugguaggcaucgauccuuuucggcugcuacagaacagucagguuuacagccucauucgaccaaaugagaaccccgcucacaagucucaacugguguggauggccugucauuccgcugccuucgaagaccuuagaguccugucauuuaucaaagggacaaagguguugccuaggggaaaacucagcacucgcggcgugcagaucgcaaguaacgagaauauggaaaccauggagucuuccacacuggaguuacggagcagauauugggccauuaggacccgcucgggugggaacacgaaucagcaacgagcuucugcgggccagauauccauccagccaacuuucucaguccagcggaaccugccguuugaccguacaaccauuauggcagccuucaauggaaacacugaaggcagaacaagugauaugaggaccgagaucauacgcaugauggaaagcgcucggcccgaggacguuuccuuucaagggagaggaguguucgaacucucugaugagaaggccgcaagcccuauuguaccaucauucgacaugaguaaugaggguuccuacuuuuucggcgauaacgccgaagaguaugacaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215638 - RNA, 1698 nt, Artificial Sequence
  derived and/or modified sequence opt from Influenza A H1N1 hemagglutinin
augaaagucaaacuccuaguauuacuaugcaccuucacagccaccuacgccgacaccauauguauaggcuaccacgcaaacaacaguacagacaccguggacacaguucuggagaaaaacguaaccguaacccacagcgucaaccuauuagaaaacucccauaacgguaagcucugucuacuaaaaggaaucgcaccccuccaacuaggaaacugcagcgucgcgggcuggauccucgggaaccccgaaugcgaacuacucauaucaaaggaaagcuggucauauaucguagagaaacccaaccccgagaacggaaccugcuaccccggccacuucgccgacuacgaagaacuccgcgaacaacucagcuccgucuccucauucgagcgcuuugaaauauucccuaaagaaucuuccuggccaaaccacaccgucaccggcguuuccgcaucaugcucccacaacggcgagucuagcuucuaccggaaccuccucuggcuaaccggcaagaacggccucuaccccaaccucuccaaaucauacgcaaacaacaaagagaaagaaguccucguucucuggggcguacaccacccacccaauauaggagaccaaaaagcccucuaccacaccgaaaacgcguacgucagcguagucuccucacacuacucacgcaaauucacccccgaaaucgccaaacgcccuaaaguccgcgaccaagaagggagaaucaacuacuauuggacccuucuagaacccggcgacacaaucaucuucgaagcgaacgguaaccucaucgccccacgauacgccuucgcccucuccagaggcuucggguccggcaucaucaauuccaacgcucccauggacaaaugcgacgccaaaugccagaccccacagggcgcaaucaacuccagccuccccuuccaaaacguacaccccgucacaauuggagagugccccaaauacguccgauccgccaaacuccggaugguaaccggacugcgcaacaucccauccauacaaagccguggucuauucggcgcaauagccggcuucauagaaggcggcuggaccggcauggucgacggcugguacggauaccaccaccaaaacgaacaaggaaguggcuacgccgccgaccaaaaaucaacccaaaacgccaucaacggaauaaccaacaaaguaaacuccgucauagagaaaaugaacacccaauucacagccguaggaaaagaguucaacaaacucgaacgccgcauggaaaaucuaaacaagaaagucgacgacggauucauagacaucuggaccuacaacgcggaacuccuaguccuauuagagaacgaacgaacccuagacuuccacgacuccaacgucaaaaaccuauacgaaaaagucaaaucacaacucaaaaacaacgccaaagaaaucggaaacggaugcuucgaguucuaucacaaaugcaacgacgaaugcauggaauccgucaaaaacggcaccuacgacuaucccaaauacuccgaagaaagcaaacuaaaccgagaaaagaucgacggcgucaaacucgaauccaugggcguuuaucaaauacuagccauauacucaaccgucgccucaucacucguccuccucguuucccucggagccauuagcuucuggaugugcuccaacggcucccuccaaugccgcauaugcauauaa

SEQ ID NO: 215639 - RNA, 1698 nt, Artificial Sequence
  derived and/or modified sequence opt from Influenza A H1N1 hemagglutinin
augaaaguuaaacuccucguacuacugugcaccuucaccgcaaccuacgccgacaccaucugcauaggguaccacgccaacaacagcacagacaccgucgacacagucuuagagaaaaacgucaccgucacccacucggucaaccuccuagagaacucacacaacgggaaacuaugccuacuaaaaggaauagccccacuacaacucggcaacuguuccguagccggguggauccucggaaaccccgaaugcgaacuccucaucuccaaggaauccuggucauacauagucgaaaaaccaaaccccgagaacggcacgugcuaccccggccacuucgcagauuacgaagaacuacgcgagcaacucagcucagucagcagcuucgaacgauucgaaaucuuccccaaggaaucaagcuggcccaaccauacagucaccggcguauccgcaagcugcucccacaauggcgaaucguccuucuaucgaaaccuucucuggcuaacaggcaaaaauggccuauaccccaaccuaucaaaaucguacgcaaacaauaaagaaaaagaaguacucguccucuggggcguccaccacccaccaaacaucggaaaccaaaaagcacucuaccacaccgaaaacgcguacgucuccgucguauccucccacuacucccgcaaauucacacccgaaaucgccaaacgcccaaaaguacgcgaccaagaaggcaggauaaacuacuacuggacccuucucgaaccaggagacacaauaauauucgaagccaacggcaaccucaucgcaccacgauacgccuucgcacucucccgcggguucggcagcggaauaauaaacucaaacgccccaauggacaaaugcgacgccaagugccagacaccgcaaggcgcaauaaacagcucccuccccuuccaaaacguacacccaguuaccauaggcgagugcccaaaguacguccgcagcgccaaacugcgcauggucaccggccuccggaacauaccaagcauccaaucccggggccucuucggcgccaucgcgggcuucauagagggcggauggacgggcauggucgacggcugguauggauaccaccaccaaaacgagcaaggcuccgguuacgccgcagaccaaaaaucaacccaaaacgccauaaacgggauaaccaacaaaguaaacagcgugauugaaaagaugaacacccaauucacagccgucggaaaagaauuuaacaaacucgaacgccgcauggaaaaccuaaacaagaaagucgacgacggauucauagacaucuggaccuacaacgccgaacucuuaguccuacucgaaaacgaaagaacacuagacuuccacgacucaaacgucaaaaaccuuuacgaaaaaguaaaaagccagcucaaaaacaacgcaaaagaaaucggcaacggaugcuucgaguucuaucacaaaugcaacgacgaaugcauggaaucagucaaaaacggcaccuacgacuaccccaaauacagugaagaaaguaaacuaaaccgcgagaaaauagacggcgucaaacucgaguccaugggagucuaccaaauccuagccauauacuccacagucgcuagcucccuaguacuacucgucagccucggcgccaucucauucuggaugugcagcaacggcucccuccagugccgcauaugcaucuaa

SEQ ID NO: 215640 - RNA, 1701 nt, Artificial Sequence
  derived and/or modified sequence opt from Influenza A H1N1 hemagglutinin
augaaagcuauccuagucguccucuuauacaccuucgcaaccgcaaacgccgacacacuuugcaucggcuaccacgccaacaacagcaccgacaccguggacacuguacucgaaaagaacgucaccgucacccacagcguaaaccuacucgaagacaaacacaacggcaaacuaugcaaacucagagguguagccccacuccaccuaggaaagugcaacauagcaggcuggauccugggcaacccagaaugcgaaucucucuccaccgccuccuccugguccuacauaguagaaacccccaguucugacaacggcacuugcuaucccggcgacuucaucgacuacgaagaacuaagagaacaacucucuuccgucagcucuuucgagcgcuucgaaaucuucccaaaaacgucaagcuggcccaaccacgacuccgacaagggagucacagccgcaugcccacacgccggcgccaaaucauucuacaaaaaccucauauggcucguaaagaaaggcaacagcuaccccaaauuauccaagagcuacaucaacgacaaaggcaaagaaguacucguacucuggggcauccaccaccccucaaccagcgcagaccagcaaucacucuaccaaaacgccgacgccuacgucuucgucggcagcucacgcuacucaaaaaccuucaaaccagaaauagcgauccgacccaaaguccgagaccgagaaggacgcaugaacuacuacuggacccuaguggagcccggcgacaaaaucaccuucgaagcaaccggaaaccucgucguaccccgcuacgccuucgccauggaacgcaacgccggauccgguaucauaauaucagacacacccguacacgacugcaacacaaccugccaaacccccaaaggagccaucaacaccagucuccccuuccagaacauccacccaaucaccauaggaaaaugcccaaaguacgucaaauccaccaaacuccgccuggccacaggacuccggaacaucccauccauccagagccgcggccuauucggcgcaauagccggcuucaucgaaggaggcuggaccggcaugguagacggcugguacggcuaccaccaccaaaacgaacagggguccggauacgcggcagaucuaaaauccacacaaaacgccaucgacgaaaucaccaacaaagucaacucagucaucgagaaaaugaacacacaguucaccgccgucggcaaagaguucaaccaccucgaaaaacgaaucgaaaaccugaacaagaaaguagacgacggauuccuagacauauggacauacaacgccgaauuacugguccugcuggaaaacgaaagaacacucgacuaccacgacagcaacgugaaaaaccucuacgaaaaaguacgaucacaacucaaaaacaacgccaaagaaaucggcaacggcugcuucgaguucuaccacaaaugcgacaauaccugcauggaaagcgugaagaacggcaccuacgacuacccgaaauacagcgaagaagccaaacuaaaccgagaagaaaucgauggagucaaacuagaaagcacacgaaucuaccaaauacuagccaucuacuccaccguagcuucaucccucguccuagucgucagccuuggagcaaucagcuucuggaugugcagcaacgguagccuccagugccgcaucugcauauaa

SEQ ID NO: 215641 - RNA, 1701 nt, Artificial Sequence
  derived and/or modified sequence opt from Influenza A H1N1 hemagglutinin
augaaagcgauucucgucguacuauuauacaccuucgccacagccaacgccgacacccuaugcaucggcuaccacgcuaacaacuccaccgacaccguagacacaguacuggagaaaaacgugacagucacccacuccgucaaccuacucgaagacaagcacaacggcaaacucugcaaacuccgaggcguagccccgcuacaccugggcaagugcaacauagccgguuggauacucggcaaccccgaaugcgaaagccuguccacagcauccucauggagcuacaucgucgaaacgccauccuccgauaacggcaccuguuacccuggagacuucaucgacuacgaagaacugcgagaacaacucucaagcgucuccagcuucgaacgcuucgaaaucuucccuaaaaccucaagcuggcccaaccacgauucagacaagggagucaccgccgcaugcccacacgcuggagccaagagcuucuacaaaaaccuaaucuggcucguaaagaaaggcaacuccuacccaaaacucuccaaauccuacaucaaugacaaaggcaaagaaguucucguccuaugggggauccaccacccauccacaagcgccgaccaacaaucccucuaccaaaacgccgacgccuacgucuucguaggcucgucucgcuacuccaaaaccuucaaaccagaaauagcaauacgccccaaaguucgcgaccgcgaaggccgcaugaacuacuacuggacccuagucgaacccggggacaagaucaccuucgaagcaacaggcaaccuuguaguccccagauaugccuucgccauggaacgcaacgccggcuccggcauaaucauauccgacacgcccguccacgacugcaacaccacuugccaaacccccaaaggcgcgauaaacacaagccuccccuuucaaaacauccaucccaucaccauuggaaaaugcccgaaauacgucaagucuacaaaacuacgccucgccaccggccuccguaacauccccuccauccaaucccgcggucucuucggcgcaauagcaggcuucaucgaaggcggcuggacaggcauggucgacggaugguacggcuaccaccaccaaaacgaacagggauccggcuacgccgcugaccucaaaaguacccagaacgccauagacgagaucaccaacaaagucaacucaguaaucgagaaaaugaauacgcaauucaccgccgucggaaaagaguucaaccaccuagaaaaacgcauugaaaaccucaacaagaaagucgacgacgguuuccuagacauuuggacauacaacgcagagcuccucguccuacuugaaaacgaacgcacgcucgacuaccacgacagcaacgucaaaaaccuauacgaaaaagucagaucccaacucaaaaacaacgccaaagagaucggaaacggcugcuucgaguucuaccacaagugcgacaauaccugcauggaaucggucaaaaacggcacauacgacuaccccaaauacagcgaagaagccaaacucaaccgagaagagaucgacggagucaaacuagaaucaaccagaaucuaccaaauacucgccaucuacagcacagucgccuccucccuaguacucgucgucucacugggcgccaucuccuucuggaugugcucaaacggcagccuccagugucgcauaugcaucuag

SEQ ID NO: 215642 - RNA, 1701 nt, Artificial Sequence
  derived and/or modified sequence opt from Influenza A H1N1 hemagglutinin
augaaggccauacucgucgugcuccucuacaccuucgcaaccgccaacgccgacacucuuugcaucggauaccaugccaacaacuccaccgacaccguggacacaguccuagagaaaaacguaaccgucacccacuccgucaaccuccucgaagauaaacacaacggaaaauuaugcaagcuccgaggcgucgcaccccuccaccucggaaaaugcaacaucgccggauggauccucggaaaccccgaaugcgaaucccucuccaccgccagcuccuggucguacaucgucgaaacacccagcucagacaacggcacaugcuacccgggagacuucauagacuacgaagaacuacgugaacaacucucuucaguauccagcuucgaacgcuucgaaauauuccccaaaaccuccucauggccaaaccacgacuccgacaaaggagucaccgcagccugcccgcacgcaggagcaaaauccuucuacaaaaaccucaucuggcucgucaagaaaggaaacagcuacccaaaacucucaaaauccuacaucaacgacaaagguaaagaaguccuaguccucuggggcauacaccaccccucaaccuccgcagaucaacaaucgcucuaccaaaacgccgacgcauacgucuucgucggauccucacgcuacucaaaaaccuuuaaaccagaaaucgccauccgacccaaagucagagaccgcgaaggccgaaugaacuacuacuggacccucguagaacccggcgacaaaaucacauucgaagcgacagguaaccucguuguaccccgauacgcauucgccauggaacgcaacgcaggaucgggcauaaucaucucugacacgccaguccacgacugcaacacaaccugccaaaccccgaaaggagcuaucaacaccucgcugcccuuccaaaacauacaccccaucaccauaggcaaaugccccaaauacgugaaaucaaccaaacuccgucucgccaccggccuacgaaacauacccuccauacagucuagaggccucuucggcgcuaucgcaggauucaucgaaggcggauggacaggcauggucgacggaugguacggcuaccaccaccaaaaugaacagggaagcggcuacgccgccgaccuuaaauccacacaaaacgccaucgacgaaaucaccaacaaaguaaacuccguaaucgagaaaaugaacacccaauucacggccguagggaaagaguucaaccaccucgaaaaacgcaucgaaaaccuaaacaagaaaguggacgacggcuuccucgauauuuggacauacaacgcagaacuccucguccuccuagaaaacgaacgcacccucgauuaccacgacucaaacgucaaaaaccucuacgaaaagguccgcagccaacucaaaaacaaugccaaagaaaucggcaacggcugcuucgaguucuaccacaagugcgacaauaccugcauggaaucugucaaaaacggcaccuacgacuaccccaaauacuccgaagaagccaagcuaaaccgagaagaaaucgacggagucaaacuagaaagcacacgaaucuaccaaauccuagccauauacuccaccguagccuccucacucguucuggucgucucccucggggcuaucucauucuggauguguucaaacggcucccuccaauguagaauaugcaucuag

SEQ ID NO: 215643 - RNA, 1701 nt, Artificial Sequence
  derived and/or modified sequence opt from Influenza A H1N1 hemagglutinin
augaaagccauacucguagugcuccuguacacauucgccaccgccaacgccgacacccucugcauaggguaccaugccaacaacagcacugacacagucgacacagugcuagagaaaaacgucaccgucacgcacuccgugaaccuacuugaagacaaacacaacggcaaacucugcaagcugcggggcgucgcuccucuccaccucggcaaaugcaacauagccggcuggauccucggcaaccccgaaugcgaaucccucucaacggccuccucgugguccuacauagucgaaacccccuccagcgacaacggaaccugcuaccccggcgacuucaucgacuacgaagaauuacgggaacagcuuucaucugucagcucauucgaaagauucgaaaucuuucccaaaaccucauccuggccaaaccaugacucaaacaagggcgucacugccgccugcccccacgccggcgcaaaaucauucuacaaaaaccucaucuggcuagucaaaaagggcaacagcuaccccaaauuauccaaauccuacaucaacgacaaaggcaaagaaguccucguccuuuggggcauccaccacccauccacaagcgccgaccaacaaucacucuaccaaaacgccgacgcauacguauucgucggaagcucccgcuacucaaagaaauucaaacccgaaauagccauccgccccaaaguccgugaccaagagggcagaaugaacuacuacuggacccucgucgaacccggcgacaaaauaacguucgaagcaacuggcaaccuagucgucccaagauacgccuucgccauggaacgcaacgccggcuccggcaucauaauaucggacacccccguccacgauugcaacacuaccugccaaaccccaaaaggagccaucaacacgagccucccauuccaaaacauccaccccaucacaaucggaaaaugcccaaaauacgucaagagcaccaaacucagacuagcaaccggccuucgaaacauccccucaauacaaucccguggacucuucggcgcuaucgcaggcuucauagaaggcggcuggaccggcauggucgacggcugguacggcuaccaccaccaaaacgaacagggauccggauacgccgcggaccuaaaauccacccagaacgccaucgaugaaaucaccaacaaggucaacuccgucauagagaaaaugaacacccaguucaccgcagucggcaaagaguucaaccaucuagaaaaacgcauagaaaaccuaaacaagaaagucgacgacggcuuccuagacauauggacauacaacgccgaacuuuuagucuuacuugaaaacgaacgcacccuggacuaccacgacagcaacgucaaaaaccucuacgaaaaaguacgcucccaacugaaaaacaacgccaaagaaaucggcaacggcugcuuugaguucuaccacaaaugcgacaauaccugcauggaauccguuaaaaacggaaccuacgacuaccccaaauacucagaagaagccaaacucaaccgcgaagaaaucgacggcgucaaacuagaauccacaaggauauaccagauccuggccauuuacuccacaguagcuucuucacucguccucgucgucucccugggagccaucagcuucuggaugugcuccaacggcucacuccaaugccgcaucugcauauaa

SEQ ID NO: 215644 - RNA, 1701 nt, Artificial Sequence
  derived and/or modified sequence opt from Influenza A H1N1 hemagglutinin
augaaagccauccuaguaguacuccuguauaccuucgcaaccgccaacgcagacacccucugcauaggauaccacgccaacaacuccaccgauacuguagacacaguccuggagaaaaaugucaccguaacccacagugugaaucugcucgaagacaaacacaacggcaaacuaugcaaacuccgcggcgucgccccucuacaccucgggaaaugcaacauugccggcuggauccucggaaacccagaaugcgaaucccuaagcaccgccuccuccuggucauacauaguagaaacgccauccucagacaacggcacuugcuaccccggagacuucauagacuacgaagaacuccgcgaacaacucuccagcgucagcuccuucgaacgauucgaaauauuccccaaaaccucuuccuggcccaaccacgauucgaacaaggguguaaccgcagcaugcccccacgcaggagccaaauccuucuacaaaaaccugauauggcucgucaagaaaggaaacagcuaccccaaacuauccaaaucauacaucaacgacaaaggcaaagaaguccucguccucuggggaauacaccaccccucaacuucagcagaucaacaaucacuauaccaaaacgccgacgccuacguguucgucggcucaagcagauacagcaagaaauucaaaccagaaaucgcaauacgcccaaaaguccgcgaccgcgaaggccguaugaacuacuacuggacgcucguagaacccggagacaaaauuaccuucgaagcaaccggcaaccucguugucccacgauacgccuucgcaauggagcgaaacgcaggcagcggaaucaucauaucagacacaccgguacacgacugcaacacaaccugccaaacccccaaaggcgccaucaacacaucccugcccuuccaaaacauacacccaaucaccaucgguaaaugcccaaaauacgucaaaucaaccaaacuccgacucgccaccggccuccgaaacauucccagcauccaaucccgcggccucuucggcgccaucgcgggcuucaucgaaggcggauggaccggcauggucgauggcugguacggcuaccaccaucaaaacgaacagggcagcggcuacgccgccgaccucaaauccacccaaaaugccaucgacgaaaucaccaacaaagucaacagcgucaucgagaaaaugaacacacaauucaccgccguaggcaaagaauuuaaccaccucgagaaaagaaucgaaaaucuaaacaagaaaguagacgacggauuccucgacauauggaccuacaacgcugaacuacucguccuccucgaaaacgaacgaacccucgacuaccacgacucaaacgucaaaaaccucuacgaaaaaguaagaagccaacucaaaaacaacgcgaaagaaaucggcaacggcugcuucgaguucuaccacaaaugcgacaauaccugcauggaaucagucaaaaacggaaccuacgauuaccccaaauacagcgaagaagcuaaacuaaaccgcgaagaaaucgacggcgucaaacuagaauccaccagaaucuaccaaauucucgccaucuacucaaccgucgccagcucccucguucuagucguaagccuaggcgccaucucauucuggaugugcagcaacggaucacuccaaugccgcaucugcaucuaa

SEQ ID NO: 215645 - RNA, 1701 nt, Artificial Sequence
  derived and/or modified sequence opt from Influenza A H1N1 hemagglutinin
augaaagccauccuagucgugcugcucuacacauucgccacagccaacgccgacacccuaugcaucggcuaccacgccaacaacagcacagacacagucgacacaguccuagaaaagaacgucacaguaacacauagcguaaaccuacucgaagacaaacacaacggaaaacuaugcaagcuccgcggcgucgcgccauuacaccucggaaaguguaacauagcaggcuggauccuaggcaacccagaaugcgaaucccugucgaccgccucaagcuggagcuacaucguggaaaccccuuccagcgacaacgggaccuguuaccccggcgacuucauagacuaugaagaacucagagaacaacuaucaucugucuccucguucgaacgcuucgaaauauucccgaaaacguccucauggcccaaccacgacucgaauaaaggcgucacagcagcaugcccucacgccggagccaagagcuuuuacaaaaaccugaucuggcuagucaagaaaggcaacagcuaccccaaacucucuaaaucguacauaaacgacaaaggcaaagaaguccuaguccucuggggcauacaccaccccagcacaagcgccgaccaacaaucccucuaccagaacgcagacgcauacguauucgucggcagcucacgcuauuccaagaaauucaaacccgaaauagccauccgacccaaaguccgcgaccaagaaggcaggaugaacuacuacuggacacucguugaacccggugacaaaauaacuuuugaagcgaccggcaacuuaguaguaccccgcuacgccuucgccauggaacgcaacgccggcagcgggaucauaauauccgacacgccaguccacgacugcaacaccacaugccaaaccccaaagggggccauaaacacaagccugcccuuccaaaacauccaccccauaaccaucggcaaaugccccaaauacgucaaaagcacaaaacuacgccucgcaaccggacugcgcaacaucccgucaauucaaucgcgcggccucuucggggcaaucgcgggauucaucgaaggcggcuggacaggcauggucgacggcugguacggguaccaccaccaaaacgaacaagguagcggauaugcagccgacuuaaaauccacccaaaacgccaucgacgaaaucacaaacaaaguuaacuccgucaucgagaaaaugaacacacaauuuaccgcaguaggaaaagaguucaaccaccucgaaaaacgcauagaaaaccucaauaagaaagucgacgacggcuuccuagacaucuggacauacaaugccgaacuacucguccuacuagagaacgaaagaacacucgauuaccacgacucgaacgucaaaaaccuuuacgaaaaaguaagaucccaacucaaaaacaacgcaaaagagauugggaacggaugcuucgaguucuaccacaaaugcgacaauaccugcauggaaucagucaaaaacggcacguacgacuaccccaaauacagcgaagaagccaaacucaaccgcgaagaaaucgacgggguaaaacucgaauccacccgcauuuaccaaauccuagccaucuacucaaccguagccucgucccugguccugguagucagccuaggugcgauaucauucuggaugugcagcaacggaucacuccauugccggaucugcgucuaa

SEQ ID NO: 215646 - RNA, 1701 nt, Artificial Sequence
  derived and/or modified sequence opt from Influenza A H1N1 hemagglutinin
augaaagccauccuaguagugcuccuauacaccuucgcaaccgccaacgccgacacacuaugcauaggcuaccacgccaacaacucaacugacaccguagacacaguccuagagaaaaacgucacaguaacccacagcgucaaccuacucgaagacaaacacaacggcaaacuuugcaaacuccgcggaguagcgccccuccaccugggcaaaugcaauauagccggauggauccucggcaaccccgaaugcgagucacuguccaccgccuccuccugguccuacauagucgaaacccccucaagcgacaacggcaccuguuaccccggcgacuucaucgacuacgaagaacuccgcgaacaacucuccucaguuucauccuucgagcgcuucgaaauauuccccaaaaccuccagcuggccaaaccacgacagcaacaaaggcgugacagccgcaugcccccacgcaggcgcaaagagcuucuacaaaaaccucaucuggcucgucaagaaaggcaacuccuaucccaaacucuccaaauccuacaucaacgauaaaggcaaagaagugcucguccucuggggaauacaccacccacccacauccgccgaccaacaaucccucuaccaaaacgcagacgcauacguauucgucggcucgucgcgcuacuccaagaaauucaaacccgaaaucgcaauccgccccaaaguacgcgaccaagaaggccgcaugaacuacuacuggacccucgucgaacccggcgacaaaauaacauucgaagccacuggaaaccucgucgucccccgcuacgcauucgcgauggaacgcaacgccggcagcggaauaauaaucuccgacacacccguccacgacugcaacacaaccugccagacccccaaaggcgccaucaacaccucacuccccuuccaaaauauccaccccaucaccauaggcaaaugccccaaauaugucaaaagcacuaaacugcgccuugccacaggccuccgcaauaucccuuccauacaaucccgcggacuuuuuggugcaaucgcaggcuucauagaaggcggauggacaggcauggucgacggcugguacggauaucaccaccaaaacgaacaaggcagcggauacgccgcagaccucaaaagcacacaaaacgccaucgacgaaauaaccaacaaagucaacuccguaaucgagaaaaugaacacacaauucaccgccgucggcaaagaauuuaaccaccuggaaaaacgaaucgaaaaccucaacaagaaaguagacgacggcuuccuggacaucuggacguacaacgccgaacuacucguacuacucgaaaacgaacgcacccucgacuaucaugacucaaacgucaaaaaccucuacgaaaaaguacgcucccaacucaaaaacaacgccaaagaaauaggaaacggcugcuucgaguucuaccauaaaugcgacaauaccugcauggaaucagucaaaaacgggaccuacgacuaccccaaguauuccgaagaagccaaacucaaccgcgaggaaaucgacgggguaaaacuugaaucaacccgaaucuaccaaauacuagcaauuuacuccaccguagccagcucccucguccuaguaguaucucucggagccaucucauucuggaugugcuccaacggcucacuccaaugucgcaucuguaucuag

SEQ ID NO: 215647 - RNA, 1701 nt, Artificial Sequence
  derived and/or modified sequence opt from Influenza A H1N1 hemagglutinin
augaaagcaauccucguaguccuccuauacacauucgcgacagcgaacgccgacacccuaugcaucggcuaccacgccaacaacuccacagacacagucgacacgguccucgaaaagaacgucaccguaacacacagcguaaaccuacucgaagacaaacacaacggcaaacuaugcaaacuacgaggcguagcaccccuccaccuaggaaaaugcaacauagccggcuggauccucggcaacccagaaugcgaaucccucagcacagccuccagcugguccuacaucguagaaacccccucguccgacaacggcacaugcuaccccggcgacuucaucgacuacgaagaacuccgggaacagcucucguccguauccucguucgaacgauucgaaaucuuccccaacaccagcucauggccaaaccacgacuccaacaaaggcgucaccgccgccugcccccacgccggggccaagagcuucuacaaaaaccucauauggcucgucaagaaaggaaacagcuacccaaaacucuccaaaagcuacauaaacgauaaaggcaaagaaguccucguccuauggggcauacaccauccaagcacaagcgccgaccaacaaucacucuaccaaaacgccgacgccuaugucuucgucggcagcucacgcuacuccaagaaauucaaaccagaaaucgccauacgacccaaaguacgcggacaagaaggcagaaugaacuacuacuggacccuaguagaaccaggagacaaaauuacuuucgaagcaacgggcaaccuaguagucccacgauacgccuucgccauggaacgaaacgccggcuccggaauaaucaucucggacaccccaguucacgacugcaauacuacuugccaaaccccaaaaggcgccaucaacacgagucucccauuccaaaacauccaccccaucacaaucggcaaaugccccaaauaugucaaaucaacgaaacugcgccucgccacuggccuacgcaacauccccagcauacagucacgcggacucuucggcgcaaucgccggauucaucgaaggcggcuggaccggcaugguagacggcugguacggauaccaccaccaaaacgaacagggcucaggcuacgccgccgaccucaaauccacccaaaacgccaucgaugaaaucaccaacaaaguaaacagugucauagagaaaaugaauacacaauucacagccguaggcaaagaguucaaccaccuagaaaaacgcaucgaaaaccucaacaagaaagucgacgacggauuccucgacauuuggacauacaacgcggaacuccucguccuccucgaaaacgaaagaacacucgacuaccaugacucaaacguuaaaaaccuguacgaaaaaguccgaagccaacucaaaaacaacgccaaagaaauaggcaacggcugcuucgaguucuaccacaaaugcgacaacacgugcauggaaucggucaaaaacggcaccuacgacuaccccaaguacucagaagaagcaaagcuaaaccgcgaagaaauugauggcgucaaacucgaaagcacucgcaucuaccaaauccucgccauauacucuaccguagccaguucccucguccuaguaguaagccugggagcaaucucauucuggaugugcuccaauggcagccuccaaugccgcauaugcauauag

SEQ ID NO: 215648 - RNA, 1701 nt, Artificial Sequence
  derived and/or modified sequence opt from Influenza A H1N1 hemagglutinin
augaaagccauccucguagugcuccuauacaccuuugccaccgcgaacgccgacacccucugcauuggcuaccacgccaacaacuccacugacaccguugacaccguccuagaaaagaacgucaccgucacccacuccguaaaccuucuugaagacaaacacaacgggaagcucugcaagcuacgaggcguagcuccucuccaccuaggaaagugcaacaucgcaggauggauccuaggcaaccccgagugcgagucacucucuaccgccuccucaugguccuacaucguugaaaccccuuccucagacaacggcacaugcuaccccggagacuucaucgacuacgaagaacuacgcgagcagcucucauccguauccuccuucgaacgauucgaaaucuuccccaaaacauccucauggccgaaccacgacucaaacaaaggcguaacugcagccugcccccacgcaggcgcuaaaucauucuacaaaaaccucauauggcucgugaagaaaggaaacuccuacccaaaacucuccaaauccuacaucaacgacaaaggcaaggagguccuaguacuauggggcauccaccacccauccaccuccgccgaccaacagucacuguaccaaaacgcagaugcauacgucuucgucgguuccucucgcuacuccaaaaccuucaaacccgaaaucgccauccgcccuaaaguucgugaccgggaaggccgcaugaacuauuacuggacacucgucgaacccggagacaaaauaacauucgaggcaaccggcaaccucgucguccccagauacgccuucgccauggaacgaaacgcuggcucgggaaucaucaucucagacacccccguccacgacugcaacacgaccugccaaaccccaaaaggagccauaaacaccagcuuaccuuuccaaaacauccaccccauuaccaucgggaaaugccccaaauacgucaaauccaccaaacuucgccucgccaccggacugcgcaacauacccuccauucaaucacgcggacuauucggcgccaucgccggauucaucgaaggaggauggaccggcauggucgauggcugguacggcuaccaccaccaaaaugaacagggcucaggauaugcagcagaccuuaaaagcacccaaaaugccaucgacgaaaucaccaacaaaguaaacucagucaucgagaaaaugaacacacaauuuaccgccguaggaaaggaguucaaccacuuagaaaaacgaaucgaaaaccugaacaagaaaguagacgacggcuuccuagacaucuggacauacaacgccgaacuacucguccugcucgaaaacgaacgcacccucgacuaccacgacagcaacgucaaaaaccucuacgaaaaaguccgcucccaacucaaaaacaacgccaaagaaaucggcaacggcugcuucgaguucuaccacaaaugcgacaauaccugcauggaauccgugaaaaacggaaccuacgacuaccccaaauacucagaagaagccaaacuaaacagagaagaaaucgacggcgucaagcucgaaagcacccgcauuuaccagauccucgccauauacuccacaguagcaucaucccucguccucguaguaucccucggcgccaucagcuucuggaugugcagcaacggcucccuacaaugccgaauaugcauauag

SEQ ID NO: 215649 - RNA, 1701 nt, Artificial Sequence
  derived and/or modified sequence opt from Influenza A H1N1 hemagglutinin
augaaagcuauucuaguaguccuccucuacacuuuuacaaccgccaacgcggacacccucugcaucggcuaccacgccaacaacuccaccgacaccgucgacaccguccucgaaaagaauguaacagucacacacuccgucaaccuccuugaagacaagcacaacggcaaacuauguaaacuacgaggcgucgcaccccuacaccucggaaaaugcaauaucgccggcuggauccucggcaacccugaaugcgaaagccucuccacagccuccuccuggucauacauagucgaaaccagcaacuccgacaacggcacaugcuaucccggagacuucauaaacuacgaagaacuccgagaacaacuauccuccgucuccuccuucgaacgauucgaaaucuuccccaaaacguccagcuggcccaaccacgacucaaacaaagggguuacagcagccugcccacaugcaggcgccaaaucuuucuacaaaaaccucauauggcucguaaagaaagggaacucauaccccaaacucaaccaauccuacauuaacgacaaagguaaagaaguccucguccucuggggcauacaccaccccuccacuacggccgaccaacaaagccucuaccaaaacgccgacgcauacgucuucgucggcacgucaagauacuccaagaaauucaaacccgaaaucgcuacaagacccaaaguccgcgaccaagaaggccgcaugaacuacuacuggacccuugucgagcccggcgacaaaauaaccuuugaagccaccggcaaccucguagucccccgcuacgcauucaccauggaacgaaacgccggcucaggcaucaucaucuccgacacuccgguccacgacugcaacaccacaugccagaccccagaaggcgccauaaacacaucucuccccuuccaaaacauacacccaauuaccaucggcaagugcccuaaauacguaaaauccacaaaacuucgccucgccacuggccuccgcaacguacccuccauccaaucccgaggccucuucggcgcaaucgccggcuucaucgagggcggguggaccggcauggucgacggaugguacggcuaccaccaccaaaaugaacaaggguccggcuacgccgccgaccuaaaguccacucaaaacgccaucgacaaaaucaccaacaaagucaacuccguaaucgagaaaaugaauacacaguucacggccguaggcaaagaguucaaccaccucgaaaagcgaauagaaaaccuuaacaaaaaggucgacgacggauuccuugacauauggacauacaacgcggaacuccucguccuccucgaaaacgaaagaacccuagacuaccacgacagcaacgucaaaaaccucuacgaaaagguacgaaaccaacuuaaaaacaacgcuaaagaaaucggaaacggcugcuucgaguucuaccacaagugcgacaacacuugcauggaaucugucaaaaacggcacauacgacuacccaaaauauucugaagaagccaagcucaaccgagagaaaauagacggcguuaaacucgaaucaacacgaaucuaccaaauccucgccauauacagcacggucgccucaucacucguccucguaguaucccucggggccauauccuucuggaugugcuccaacggcucccuacaaugccggauaugcauauaa

SEQ ID NO: 215650 - RNA, 1701 nt, Artificial Sequence
  derived and/or modified sequence opt from Influenza A H1N1 hemagglutinin
augaaagcaauccuuguaguccuccuguauaccuucaccacagcgaacgccgacacccucugcauaggcuaccacgccaacaacucgaccgacaccguggacaccguccucgaaaaaaacguaaccgucacacacagcgucaacuuacuugaagacaaacacaacggaaaacuuuguaaacuacgaggggucgccccacugcaccuaggaaaaugcaacauagccggauggauccucggcaaccccgaaugcgagagccugagcacagccuccagcuggagcuacaucgucgaaacauccaacuccgacaacggaacaugcuaccccggcgacuucaucaacuacgaagagcuaagagaacaacucagcuccguaaguuccuucgagcgauucgaaaucuuccccaagacgaguuccuggccaaaccacgacucgaacaaaggcgucaccgcagcaugcccgcacgcaggagcaaaaagcuucuacaaaaaccugaucuggcuaguaaaaaaaggaaacagcuaccccaaacucaaccaauccuacaucaacgacaaaggcaaagaaguccucguccuauggggcauccaccaccccuccacuaccgcggaccaacaaucccucuaccaaaaugccgaugccuacgucuucgucggaaccucacgauacucaaaaaaauucaaaccggaaauagccacccgcccaaaaguccgagaccgcgagggccggaugaacuacuauuggacccuaguagagcccggagacaaaaucacuuucgaagcaaccggaaaccugguaguaccgcgauacgccuucacaauggaacgaaacgcaggcagcggaaucauuauaucagacacuccgguccacgauugcaacacaacaugccagaccccagaaggcgcuaucaacaccagccugcccuuccaaaacauucacccaauaacaaucggcaagugcccaaaauacgucaaaagcaccaaacugcgucucgcaaccggacuacgcaacguccccagcauacaaucgcgcggccucuucggcgccauagcaggauucaucgaaggaggguggaccggcaugguagacggcugguacggauaccaccaccaaaacgaacaaggcuccggcuacgcagccgaccucaaaagcacacaaaacgccauagacaaaaucaccaacaaagucaacagcgugaucgaaaaaaugaacacccaauucacagccgucggcaaagaauucaaccaccuugagaaacgcauagaaaaccuaaacaaaaaagucgacgacggcuuccuagacaucuggaccuacaaugcagagcugcucguccuccucgaaaacgaacgaacgcuagacuaccacgacagcaacgucaaaaaccucuacgaaaaaguccgcaaccaacucaaaaacaaugcaaaagaaauaggcaauggcugcuucgaauucuaccacaaaugcgacaacaccugcauggaauccgucaaaaacggaaccuacgacuaccccaaauacucagaagaggcaaaacuaaaccgagagaaaauagacggcgucaaacucgagucaacccgcaucuaccaaauccuggccauauacuccaccguugccuccucccuaguacuuguagucucccucggcgcuaucuccuucuggauguguucaaacggcucccugcaaugccgaauaugcauauaa

SEQ ID NO: 215651 - RNA, 1701 nt, Artificial Sequence
  derived and/or modified sequence opt from Influenza A H1N1 hemagglutinin
augaaagcgauacucguaguacuccucuacaccuucaccaccgcaaacgccgacacccuuugcaucggcuaccacgcaaacaacuccacugacacaguagacaccguccuagagaaaaacguaaccguaacccacucggucaaccuacucgaagacaaacacaacgggaaacucugcaaacuccgaggcgucgcaccccuccaccugggaaaaugcaacauagccggauggauccucggcaacccagaaugugaaucccucuccaccgccuccucauggagcuacaucgucgaaaccucaaacuccgacaacggcacuugcuacccgggcgacuuuaucaacuacgaagaacuacgcgaacaacucuccucagucagcucauuugaacgauuugaaaucuuccccaaaacgucuuccuggccaaaccacgacuccaacaaaggcguaaccgccgccugcccccacgccggugcaaaauccuucuacaaaaaccucaucuggcucgucaagaaaggcaacagcuaccccaaacuaaaccaaucauacauaaacgacaaaggcaaagaaguccucguccuuuggggaauccaccaccccucgacaaccgcagaccaacaaagccucuaccaaaacgccgacgccuacgucuuugucggcaccucccgcuacagcaaaauguucaaacccgaaauagccacucgaccaaaaguccgcgaccgggaaggccgaaugaacuacuacuggacccuaguagaaccgggagacaaaauaaccuucgaagcuaccggcaaccuaguugucccacgcuacgccuucacaauggaacgcaacgccggcuccggcaucaucaucucagacacacccguccacgacuguaacacgaccugccagacccccgaaggcgcuauaaacaccucacuccccuuccaaaacauacaccccaucaccaucggcaaaugccccaaauacgucaaaucgacaaaacuccgucuagccaccggacuacgaaacguucccagcauucaaucgagaggucuauucggcgccauagcaggcuucaucgaaggcggauggacaggcaugguagacgguugguacggcuaccaccaucaaaacgaacaagggucaggauacgcugcagaccucaaguccacacaaaacgccauagacaagaucacgaacaaagucaacucagucaucgaaaagaugaacacacaauucacggcaguaggcaaagaguucaaucaccuggaaaaacgcauagaaaaccucaacaagaaaguugacgacggcuuccuagacaucuggacauacaacgcugaacuccuaguccuacuagaaaacgagcgcacacucgacuaccacgacagcaaugucaaaaaccucuacgaaaaaguacgcaaccagcugaaaaauaacgccaaagaaauaggcaacggcugcuucgaguucuaccacaaaugcgacaauaccugcauggaaucugucaaaaacggaaccuacgacuaccccaaauacagcgaagaagcaaaacucaaccgagagaaaaucgacggagucaaacuugaaucaacgcgaaucuaccagauacucgccaucuacagcaccgucgccucaucccuaguccucguagucucacuaggcgcgaucuccuucuggaugugcuccaacggcagccuucaaugccgaaucuguaucuga

SEQ ID NO: 215652 - RNA, 1701 nt, Artificial Sequence
  derived and/or modified sequence opt from Influenza A H1N1 hemagglutinin
augaaagcgauccucgucguccuacucuacaccuucgccaccgcaaacgcagacacacucugcaucggcuaccacgcaaauaacuccaccgacacagucgacaccguccucgagaaaaacgucaccguaacccacagcgucaaccuccuagaagacaaacacaacggcaaacuaugcaaacuacgcggcgucgcaccccugcaccuaggaaaaugcaacaucgccggguggauacuaggcaaccccgaaugcgaaagccuaucaaccgccuccucaugguccuacaucguagaaaccuccagcuccgacaacggcacaugcuaccccggcgauuucauagacuacgaagaacuccgcgaacaacuaagcuccguaagcagcuucgaacgcuucgaaaucuuccccaaaacguccucuuggccaaaccacgacuccaacaagggaguuacagccgccugcccgcacgccggggccaagagcuucuacaaaaaccuaaucuggcuaguaaagaaaggaaacagcuacccaaaacucucuaaaagcuauauaaaugacaaaggaaaagaaguccuaguccucuggggaauccaucaccccagcacaagcgcagaccaacaaagccucuaccaaaacgccgacgccuacgucuucgucggcagcucccgcuacagcaagaaauucaaaccagaaaucgccauacgccccaaaguccgggaccaggaaggcagaaugaacuacuacuggacccucguagaacccggcgacaaaauaaccuucgaagccacgggaaaccuggucguaccuagauacgcauucgccauggaacgcaacgccgguagcggcauaaucaucucggacaccccaguccacgacugcaacacaaccugccagacccccaaaggggccauaaacaccagccucccauuccaaaacauccacccaaucacaauaggcaaaugccccaaauacgucaaaagcacaaaacuacgccuagcgaccgggcuccgcaauguaccgagcauccaaucacgaggccucuucggggcuaucgcaggauucaucgaaggaggcuggaccggaaugguagacggcugguacgguuaccaccaccaaaacgaacaaggaagcgguuacgccgcagaccuaaaauccacccaaaaugccaucgaugaaauaacaaacaaagucaacuccgucaucgagaaaaugaacacucaauucaccgccgucggcaaagaguucaaccaccucgaaaaacgcaucgaaaaccucaauaagaaaguagacgacggcuuccucgacauauggacauacaacgccgaacuccuaguccuacucgagaacgaacgaacccucgacuaccacgacucaaacgucaaaaaccucuacgaaaaaguucgcucacaacucaaaaacaacgccaaagagauaggaaacgguugcuucgaguucuaccacaaaugcgacaacacaugcauggaaucaguuaaaaacggcaccuacgauuacccaaaauacuccgaggaggcaaaacucaaccgagaagaaaucgacggaguaaaacuggaaagcacccgcaucuaccagauccuagccaucuacuccaccguggcauccagccucguccuaguagucagcuuaggagccauaucauucuggauguguagcaacggcucacugcaaugccgcauaugcauauaa

SEQ ID NO: 215653 - RNA, 1701 nt, Artificial Sequence
  derived and/or modified sequence opt from Influenza A H1N1 hemagglutinin
augaaagcaauccuggucguccuccucuacacauucgcaaccgccaacgcagacacucuaugcauaggcuaccacgccaacaacagcacagacaccgucgacaccguccuagaaaagaacguaaccgucacccacuccguaaaccuccucgaagacaaacacaacgguaaacuaugcaaacuccgcggggucgcaccccuacaccucggaaaaugcaacauagcaggcuggauccuaggcaaucccgaaugcgaaucacucagcaccgcauccucauggagcuacaucguugaaacauccuccagcgacaacggcacaugcuaccccggcgauuucauugacuacgaagaacuccgcgaacaacucucguccguaagcucauucgaacgcuucgaaaucuucccaaaaacauccuccuggcccaaccacgacuccaacaaaggcgucaccgcggccugcccucacgcaggcgccaaauccuucuacaaaaaccuaauauggcuaguuaaaaagggcaacuccuacccuaaacuauccaaauccuacaucaacgacaaaggaaaagaaguacuuguauuauggggcauccaccaccccagcaccagcgcagaccaacaaucccuauaccaaaaugcagacgccuacgucuucguuggcucaucacgcuacucaaagaaauucaaacccgaaauugccauccgcccaaaagugagagaccaagaaggacgcaugaacuacuacuggacacucgucgaacccggcgacaaaaucacauucgaagccaccggcaaccucgucgucccccgcuacgcauucgccauggaacgaaaugccggcuccgguauaauaaucuccgacacacccguacacgacugcaacaccacaugccaaacaccaaagggggccaucaauacaucccucccuuuccaaaauauccaucccaucacaaucggaaaaugccccaaauacguuaaaagcacaaaacuccgccucgccacaggacuacguaacgucccgucaauacaaucacgcggacucuucggcgcuauagccggguucauagaaggcggcuggaccggcauggucgacggaugguacgguuaccaccaccaaaacgaacaaggcagcggcuacgccgccgaccucaaaaguacacaaaacgccaucgacgaaaucaccaacaaagucaacuccguaaucgagaagaugaacacacaauucacggcagucggcaaggaguucaaccaccucgaaaagcgcaucgaaaaccuaaacaagaaagucgacgacggcuuccuggacaucuggaccuauaacgcagaacucuuagugcuacuagaaaacgagcgaacccuugacuaccacgacuccaaugucaaaaaccucuacgaaaaaguucgcucccagcucaaaaacaacgcuaaagaaaucggcaacggcugcuucgaguucuaccacaaaugcgacaauaccugcauggaauccgucaaaaacggcaccuacgacuacccgaaauacucagaagaagccaaacucaaccgcgaagaaaucgacggcgucaaacuagaauccacucguaucuaccaaauccuugccaucuacucaaccgucgccuccagccucguccuaguagugucacucggcgccaucuccuucuggaugugcagcaacggcucccuccaaugccgcauaugcaucuaa

SEQ ID NO: 215654 - RNA, 1701 nt, Artificial Sequence
  derived and/or modified sequence opt from Influenza A H1N1 hemagglutinin
augaaagccauccuagugguacuccuuuacaccuucgccaccgccaacgccgauacacucugcaucggauaccaugcaaacaacucaacugacaccgucgacacaguccucgagaaaaauguaacagucacccacagcguaaaccuacuagaagacaaacacaacggcaaacuaugcaaacugcgcggcgucgccccacuccaucuaggaaaaugcaacaucgcaggauggauccuaggcaacccagaaugcgagagccucuccaccgccucauccugguccuacaucgucgaaaccaguuccuccgacaauggcacaugcuacccaggagacuucauagacuacgaagaacuacgcgaacaacucuccuccgucagcuccuucgaacgcuucgaaauauucccgaaaaccagcuccuggccaaaccacgacuccaacaaaggcguaaccgccgccugcccccaugcuggagccaaauccuucuacaaaaaccugaucuggcuuguaaagaaaggaaacagcuaccccaaacuaucaaaaucuuacaucaacgacaaaggcaaagaaguccuaguacucuggggaauccaccacccguccacauccgcagaccaacaaucacucuaccaaaacgccgacgccuacguauucguuggcucaucccgauacucaaagaaauucaaaccagaaaucgcaauacgucccaaaguccgcgaccaagaagggaggaugaacuacuacuggacgcucgucgagcccggcgacaaaaucacauucgaagcgaccggcaaccucgucguaccucgauaugccuucgcaauggaacgcaacgccggcagcggcaucaucaucuccgacacacccguccacgacugcaacacgacgugccaaacccccaaaggcgccaucaacacaagccuucccuuccagaacauccacccgauaacaaucggcaaaugcccaaaauacgucaaauccaccaaacuccgacucgccaccggauuacgaaauguccccagcauacaaucacgcggacuuuucggcgccaucgcaggauucaucgaaggcggcuggaccggcauggucgacggcugguacggcuaccaccaccaaaacgaacaaggcagcggcuacgcagccgaccucaaaagcacgcaaaacgccauagacgagaucaccaacaaagucaacuccgucaucgaaaagaugaacacacaauucaccgccguaggaaaagaguucaaccaccucgaaaaacggauagaaaaucucaacaagaaagucgaugacggauuccucgacaucuggaccuacaacgcagaacuuuuaguccuccucgaaaacgaacgcacacuagacuaccacgacuccaacgucaaaaaucucuaugaaaaaguaaggucccaacucaaaaacaacgccaaagaaauaggcaacggcugcuucgaauuuuaccacaaaugcgacaauaccugcauggaauccgucaaaaacgggaccuacgacuaccccaaauacuccgaagaagccaaacuaaacagagaagaaauugacggggucaaacuggaaagcacccgcaucuaucaaauccuagcaauauacuccaccguagcauccucucuaguacucgucguaucacugggcgccaucucauucuggaugugcagcaauggcagccuccaaugccgcaucugcauuuaa

SEQ ID NO: 215655 - RNA, 1701 nt, Artificial Sequence
  derived and/or modified sequence opt from Influenza A H3N2 hemagglutinin
augaaaaccauaaucgcccucuccuacauauucugccucgcacucgggcaagaucuccccggaaacgacaacagcaccgccacgcuaugccuaggacaccacgccguccccaacggcacacucgucaaaacaauaacagacgaccaaaucgaaguaaccaacgccacagagcuaguccagagcucaagcacuggaaaaaucugcaacaacccccaccgcauacuagauggcaucgacuguacacuaauugacgcccuccucggcgacccacacugcgacgucuuucaaaacgaaaccugggacuuguucgucgaacgcagcaaagccuucagcaacugcuaccccuacgacguacccgacuacgccagccuacgcucgcuagucgccucaagcggcacccuagaauuuaucacagaaggcuucacauggacaggcgugacccaaaacgggggaucaaacgccugcaagcgcgggcccggcagcggcuucuucagcagacucaacuggcucaccaaaucaggcagcaccuaccccguacucaacgucacaaugcccaacaacgacaacuucgacaaacuauacaucuggggaguccaccacccauccaccaaccaagaacagacgucccuauacguccaagcaagcggacgaguaacaguuagcacacgccgcucccagcaaaccaucauccccaacaucggcagccgcccauggguccguggccuauccucccgcaucucaauauacuggaccaucgucaaacccggagacguacucgugaucaacagcaacggaaaucucauagcaccccgcggcuacuucaaaaugcgaacaggcaaauccucaaucaugcgcucggacgcccccaucgacacaugcaucagcgaaugcaucacccccaacggguccaucccaaacgacaagccauuccaaaacgucaacaaaaucacuuacggcgccugcccaaaauacguaaagcaaaacacauuaaaacuggccacaggcaugcgcaauguacccgaaaagcaaacccguggccucuucggcgcgaucgcuggauucauugaaaacgguugggaaggcaugaucgacggcugguacggcuuucggcaccaaaacucagaagggaccggccaagccgcagaccucaaauccacccaagccgccauagaccagaucaacggaaaacucaacagaguaaucgagaaaacaaaugaaaaauuccaccaaaucgaaaaagaguucucagaaguagaagggcgcauccaagaccucgaaaaauacgucgaagacaccaaaauagaccuguggucguacaacgccgaacuccuagucgcacuagaaaaccaacauaccaucgaucucaccgacucagaaaugaacaaacucuucgagaaaacacgacgccaacuacgagaaaacgcagaagacaugggcaacggaugcuucaaaaucuaccacaaaugcgacaacgcaugcaucgaauccauccgcaacggcacauacgaccacgacguguaccgcgacgaagcccucaacaaccgauuccaaauaaaaggaguagagcucaaaagcggcuacaaagacuggauccucuggaucagcuucgccauauccugcuuccuccugugcgucguccugcucggcuucauaaugugggccugccaacgcggcaacauacgcugcaacaucugcaucuaa

SEQ ID NO: 215656 - RNA, 1701 nt, Artificial Sequence
  derived and/or modified sequence opt from Influenza A H3N2 hemagglutinin
augaaaacaaucaucgcccucucauacauauucugccucgcccucggccaagaccuccccggcaacgacaacagcaccgccacccucugccucggccaccacgcuguccccaacggcacccuugucaaaaccaucaccgacgaccaaaucgaagucaccaacgccacagaacucguccaaagcucaucaacgggcaaaaucugcaauaacccccaccgcauacucgacggcaucgacugcacccuaauagacgcacuucucggagacccccacugcgacguauuccaaaacgaaaccugggaccucuucgucgaaagaucaaaagccuucuccaacugcuaccccuacgacguacccgauuacgccagccuacgcucacuuguagccucguccgggacucucgaguucaucaccgaaggauucaccuggaccggcguaacacagaacggcggcuccaacgccugcaagcgcggaccaggaucaggcuucuucucccgccuaaauuggcugaccaaaagcggcagcacauacccaguccucaacgucaccaugcccaacaacgacaacuuugacaagcucuacaucuggggcguccaccacccauccaccaaccaagaacaaaccucccucuacguacaagccuccggacgcguaaccgucuccacccgucgcucccaacaaacaaucauccccaacauugaaagccgaccauggguccgcggucaauccucacgaauaagcauauacuggaccauaguaaagcccggugacguccucgucaucaacucuaacggaaaccucauagcuccccgaggcuacuucaaaaugcgaacaggcaaauccuccaucaugcgcuccgacgccccgaucgauaccugcauaagcgaaugcauuacucccaacggcuccauccccaacgacaagcccuuccaaaacguuaacaaaauuaccuacggcgccugccccaaauacgucaaacaaaacacccucaaacuggccacaggaaugcgcaacguccccgaaaaacagacucgcggacuauucggcgcaauagccggcuuuaucgaaaacggcugggaaggcaugauugacggcugguacggauuccgccaccaaaacuccgaaggaaccgggcaagcggcugaucugaaguccacccaagcugccaucgaccagauaaacggaaaaguaaaccgcaucaucgaaaagaccaacgaaaaauuccaccaaauagaaaaagaguucucagaagucgaaggccgcauacaagaccucgaaaaauacguagaagacacaaaaaucgaccucugguccuacaacgcugaacuccuagucgcccucgaaaaccaacacaccaucgaucucaccgacucagaaaugaauaaacuauucgagaaaacuagacgccaacucagagaaaacgcugaagacaugggcaacggauguuucaaaaucuaccacaaaugcgacaacgcgugcaucgaaucgaucaggagcggcacauacgaccacgacgucuaccgggacgaagcacuaaacaacagauuccaaaucaaaggaguagaacuaaaaagcggauacaaagacuggauccucuggauauccuucgcuaucuccuguuuccugcucugcguaguacuccucggcuucaucaugugggccugccaacgaggcaacauucgaugcaacaucugcaucuga

SEQ ID NO: 215657 - RNA, 1701 nt, Artificial Sequence
  derived and/or modified sequence opt from Influenza A H3N2 hemagglutinin
augaaaacaaucauagcacucucauacauccucugccucguauucgcccaaaagaucccgggcaacgacaacagcaccgccacccuaugccucggccaccacgcuguccccaacggaaccauagucaaaaccauaacaaacgaccgcaucgaagucaccaacgcaacugaacugguccagaacuccaguaucggcgagaucugcgacuccccucaccaaauacucgacggcgaaaacugcacccuaauagacgcccuccuaggugacccccaaugcgacggcuuucaaaacaagaaaugggaccuauucgucgaaagaagcaaagccuacuccaacugcuacccauacgacguacccgacuacgccagcuuacgcucccucgucgccuccuccggaacacuggaguucaauaacgaaucuuucaacuggaccggcguuacccaaaacggcaccucaucugccugcauccgcagaucauccagcucuuucuucucccgacuuaauuggcucacgcaccuaaacuacaaauaccccgcccuaaacgucacaaugcccaacaacgaacaauucgacaaacucuacaucuggggcguccaccaccccggcaccgacaaagaccaaaucuuccccuacgcacaaucguccggucgcaucaucguguccaccaaacgcagccagcaagcaguaauaccaaauauaggcagucgaccccgaauccgugacauccccucccgcaucagcaucuacuggaccauugucaagcccggggacauccuccuaaucaacuccaccggcaaccucaucgcaccacgcggcuacuucaaacuucgcucaggaaaaagcuccaucaugcgcagcgacgcgcccaucggcaaaugcaaauccgaaugcaucacccccaacggauccauaccuaacgacaaacccuuccagaacgucaaccgcaucacauacggugcaugcccccgcuacguuaaacacucaacccucaaacuggccaccggaaugcguaacguccccgaaaaacaaacacgcggaauauuuggcgcaaucgcaggcuucaucgaaaacggaugggaagguauggucgacggcugguacggcuuccggcaccagaacuccgaaggacgcggucaggcggcagaccucaaaucaacacaagccgcaauagaucaaauaaauggcaaacuuaaccgccuuauaggcaaaaccaacgaaaaauuccaccaaaucgaaaaagaguucuccgaaguugaaggccgcauccaagaccucgaaaaguacgucgaagacacaaaaaucgaccugugguccuacaacgccgaacuccucgucgcccucgaaaaccaacacacaauagaccucacugacucagaaaugaacaaacuauuugagaaaacuaagaaacagcuccgcgaaaacgccgaagacaugggaaacggcugcuucaaaaucuaccacaaaugcgacaacgcaugcauaggcucaauacgaaacggcaccuaugaccacaacgucuaucgcgacgaagcccucaacaaccgcuuccaaaucaaaggggucgaacuaaaguccggcuacaaagacuggauccucuggaucuccuucgccaucucaugcuuccuccuuugcgucgcccuccuaggcuuuaucaugugggccugccaaaaaggaaacauccgcugcaacaucuguauauaa

SEQ ID NO: 215658 - RNA, 1701 nt, Artificial Sequence
  derived and/or modified sequence opt from Influenza A H3N2 hemagglutinin
augaagaccaucaucgcacucuccuacauccucugccuuguauucgcacaaaaaaucccaggcaacgacaacagcacggccacccucugccuuggacaccacgccguacccaacggaaccaucguaaaaaccaucaccaacgaccgcaucgaagugaccaacgcaacagaacugguccaaaacuccagcaucggcgaaauaugcgacuccccccaccaaauccucgacggcgaaaacuguacacucauagaugcacugcucggcgacccccaaugcgacggcuuccaaaacaaaaaaugggaccuauucgucgaacgcucgaaagcauacuccaacugcuaccccuacgacguacccgacuaugccucacucagaucccucguggccuccuccggaacccuagaauucaacaacgaaucguucaacuggacaggagucacccaaaacggcacaucaagcgcaugcauucgcagaaguucgucaucauucuucagccgacuuaacuggcucacccaccuaaacuacaccuaccccgcccucaacguuaccaugcccaauaacgaacaauucgacaagcuauacaucuggggaguacaccaccccggcacagacaaagaccaaauauuccuguacgcccaaucgagcgggcgaaucaccguaucaacaaaacguagccaacaagcugucauccccaauaucggcucccgaccccgaauccgcgauauuccaucccgcauaagcaucuacuggaccauagucaaacccggggauauccuucucaucaacuccacaggaaaccucauagcaccccgaggcuacuucaaaaucagauccggaaaauccuccauaaugcgaucagacgcccccaucggcaaaugcaaaagcgaaugcauaacaccgaauggguccauacccaacgacaagccauuccaaaacgucaaccgcauaacauacggcgccugcccgcgauauguaaaacacucaacacucaaacuagcaacaggaaugcgcaacguccccgaaaaacagacacgaggaaucuucggagccauagcaggauucaucgaaaacggcugggaaggcauggucgacggaugguacggcuuccgccaccaaaacucagaagggcgcggacaagccgcagaccucaaaagcacucaggcagccauagaccaaaucaacggaaaacuaaaccgccuaaucggcaaaacgaaugaaaaauuccaccaaaucgaaaaagaauuuucagaaguagaaggccguauacaagaccuagaaaaauacgucgaagacacaaaaaucgaccucugguccuacaacgccgaacuccucgucgcccuagaaaaccaacacaccaucgaccucacagacucagaaaugaacaaacuuuucgaaaaaacaaagaaacaacuccgcgaaaacgccgaagacaugggaaacggcugcuucaaaaucuaccacaaaugugacaacgccugcaucggauccaucagaaauggcaccuacgaccacaacgucuaccgcgacgaggcccucaauaaccgcuuccaaaucaaaggcgucgaacucaaauccggauacaaagacuggauccuauggauauccuuugccaucagcuguuuccuccucugcguagcccuacugggcuucaucaugugggccugccagaaaggaaacauacgauguaacauaugcaucuga

SEQ ID NO: 215659 - RNA, 1701 nt, Artificial Sequence
  derived and/or modified sequence opt from Influenza A H3N2 hemagglutinin
augaaaaccaucaucgcccuaagcuacauacuaugccuggucuucgcucagaaaaucccaggcaacgacaacagcacagccacgcucugccucggacaccacgccguacccaacggaaccaucgucaaaacuaucacgaacgaucgcaucgaagucaccaaugccacagaacucguacaaaacucguccauaggcgaaauaugcgacagcccccaccaaauccuagacggcgaaaacugcacacucaucgacgcacugcuaggagacccccaaugcgacggcuuccaaaacaagaaaugggaccuguucguagaacgcuccaaagcauacucaucaugcuaccccuacgauguccccgacuacgccucacuucgaucgcuuguagcauccucagggacacuagaguucaacaacgaauccuucaacuggaccggggucacccaaaacggaaccuccucagccugcauacgacggucaucuuccuccuucuucuccagacucaacuggcucacccaccucaauuacaaauauccagcccucaacguaaccaugccgaacaacgaacaauucgacaaacucuacauaugggguguccaccaccccggcaccgacaaagaccaaaucuuccccuacgcacagagcucaggccgcaucaccguauccacuaaacgcucccagcaagcagucauaccaaacaucggaucccgcccucgaauacgcgacauacccagcagaauaucaaucuacuggaccaucguaaaacccggcgacauccuccucauaaacagcacaggcaaccucaucgccccacgcggcuacuucaaaauccgguccggcaaauccuccaucaugcgcagcgacgcgcccauaggcaaaugcaaaagcgagugcauaacccccaacggcagcauacccaacgacaaaccauuccaaaacgucaaccgaaucaccuacggagcaugcccucgcuacgucaaacacuccacccucaaacucgccacaggcaugcgcaacguuccagaaaaacaaacacgcggaaucuucggcgcaaucgccggcuucauagaaaacggaugggaaggcaugguggacggcugguacggauuccgacaccaaaacuccgagggccgaggccaagcggccgaccucaaaagcacacaagcagccauagaccaaauaaacggcaaacucaacagacuaauaggcaaaacaaacgagaaauuccaccaaauagaaaaagaguucucggaaguagaaggccgcauccaagaucucgaaaaguacgucgaagacacaaaaauagaccuguggucauacaacgccgaacuccucgucgcccuugaaaaccagcacaccaucgaccucaccgacuccgaaaugaacaaacucuucgagaaaaccaagaaacaacuccgggaaaacgccgaagauauggggaacggcugcuucaaaaucuaccacaaaugcgacaacgccugcaucgguagcauacgcaacggcaccuacgaccauaacgucuacagggacgaagcccuuaauaaccgauuccaaauaaaaggcgucgaacuaaaauccggcuacaaagacuggauccuauggaucagcuucgccauaagcugcuuccuacucugcgucgcgcuacucggauucaucaugugggccugccaaaaaggcaacaucagaugcaacaucugcaucuga

SEQ ID NO: 215660 - RNA, 1701 nt, Artificial Sequence
  derived and/or modified sequence opt from Influenza A H3N2 hemagglutinin
augaaaacaaucaucgcgcuaucguacauacucugccucgucuucgcacagaaaauccccggcaacgacaacagcacagcuacccuaugccucggacaucacgccguccccaacgguacaauagucaagaccaucaccaacgaccgcaucgaagucacuaacgccaccgaacucguccaaaacucauccauaggggaaauaugcgacuccccacaccaaauccucgacggcgagaacugcacccucauagacgcucuacucggcgacccccaaugcgacggauuccaaaacaagaaaugggaccuauucguagaacgaagcaaagcauacuccucaugcuacccauaugacgucccagacuacgccucccuacgaucacucgucgcuuccuccggaacccuagaauuuaacaacgaauccuucaacuggacaggcguaacccaaaacggaaccucauccgccugcauccgacgcuccuccagcuccuucuucagccggcucaacuggcucacccaccucaacuauaaauacccagcacugaacgucaccaugcccaacaacgaacaauucgacaagcuauauauuuggggcguacaccaccccggaaccgacaaagaccaaauuuuccccuacgcccaauccagcggacgcauaaccguaaguaccaaacgaucccaacaagcagucauuccaaacaucggaucccgcccacgcauacgcaacaucccaucccgcauaucaaucuacuggaccauaguuaaaccaggugacauacuccugaucaacucaacagggaaccucaucgcaccccgaggauacuucaaaauucgcucaggcaaaucauccaucaugcgcagugacgccccuauagggaaaugcaaaagcgaaugcaucaccccgaacggaucaauccccaacgacaaacccuuccaaaacgucaaccgcaucaccuacggcgccugcccccgauacguaaaacacucaacccucaaacuagccaccggcaugcgcaacgucccagaaaaacaaacacgagguaucuucggcgccauagccggcuucaucgaaaacggaugggaagggauggucgauggaugguacggauuccgccaccagaacuccgaaggacggggccaagccgccgaucuaaaaucuacccaagcugcaaucgaccaaauaaacggaaaacuaaaccgacuuauaggcaagaccaacgaaaaauuccaucaaaucgaaaaagaguucucggaagucgaaggccgcauacaagaucuagaaaaauacgucgaagacacaaaaaucgaccucuggucauacaacgccgagcuacucgucgcccucgaaaaccaacacaccauagaccucaccgacuccgaaaugaacaagcuauucgagaaaacuaagaaacaacucagagaaaacgccgaagacaugggcaacggaugcuucaaaaucuaccacaaaugcgacaacgccugcaucgguucaauacgaaacggcaccuaugaccacaacgucuaccgugacgaagcucucaacaacagauuucaaauaaaaggcgucgaacuaaaaagcggauacaaggacuggauccuauggaucuccuucgccaucagcugcuuccuucuaugcguagcacuacucggcuucaucaugugggccugccaaaaggguaacauacgcugcaacaucugcaucuaa

SEQ ID NO: 215661 - RNA, 1695 nt, Artificial Sequence
  derived and/or modified sequence opt from Influenza A H5N1 hemagglutinin
auggagaaaaucguccuccuauucgcaaucguaucgcucguaaaauccgaccagauaugcaucggcuaccacgcaaacaacagcaccgaacaaguugacacaaucauggaaaagaacguaaccgucacgcacgcacaagacauacuagagaaaacgcacaacggcaaacucugcgaccucgacggcgucaaaccacucauacuacgcgacugcucaguagccggcuggcuucuaggaaaccccaugugcgacgaguucauaaacguccccgaauggagcuauauagucgaaaaagccaaccccgugaacgaccucugcuacccaggcgacuucaacgacuacgaagaacuaaagcaccuccuaagccgaauuaaccacuucgaaaagauccaaauaauaccaaaauccucauggagcagccacgaagccucccucggaguaucauccgcaugcccauaccaaggcaaguccucauucuuccgcaacgucgucuggcuaauaaagaaaaacuccaccuaccccaccaucaaaagguccuacaacaacaccaaccaagaagaccuccucguccuauggggcauacaccacccaaacgacgcagccgaacaaacaaaacucuaccaaaacccaaccacauacaucagcgucgggacgucaacacuaaaccaacgacucgucccccgcauugccacacgcuccaaagucaacggccaaagcgggcgaauggaauuuuucuggacgauacucaaaccuaacgacgcaauaaacuucgaaucuaacggaaacuucauagcuccagaauacgccuacaaaauagucaagaaaggcgacuccacaauaaugaaaagcgaacucgaauacggaaacugcaacacaaaaugccaaaccccaaugggcgcaaucaacuccucaaugcccuuccacaacauacacccccucacaaucggagaaugccccaaauaugucaaauccaaccgccuaguccucgcaaccggccuccgaaacucaccccaacgcgaaaccaggggacuauucggcgccaucgccggcuucauagaaggcggcuggcaaggcauggucgacggaugguacggauaccaccacagcaaugaacaaggauccggcuacgcagccgacaaagaaucaacccaaaaagcgaucgacggcguaaccaacaaagucaacucgaucaucgacaaaaugaacacccaguucgaagccgugggacgcgaguucaacaaccuagaacgcaggaucgaaaaccucaacaagaaaauggaagacggauuccucgacguuuggaccuacaacgccgaacuacucguccucauggaaaacgaacgaacacucgacuuccacgacuccaacguaaagaaccuauacgacaaaguccgacuccaacuccgagacaacgccaaagaacugggcaacggaugcuucgaguucuaccacaaaugcgacaacgaaugcauggaauccgucagaaacggcaccuacgacuacccccaauacucugaggaggcccgccuaaaacgagaagaaaucucaggcgucaaacuagaaucaaucggaauauaccaaauacucucaaucuacagcaccgucgcaagcucccucgcccucgccaucauggucgcuggccuaucccuguggaugugcucaaacggaagccuccaaugccgaauaugcauauaa

SEQ ID NO: 215662 - RNA, 1695 nt, Artificial Sequence
  derived and/or modified sequence opt from Influenza A H5N1 hemagglutinin
auggaaaagaucguccuccucuucgcaauaguaucccuagucaaaucagaccaaaucugcaucggcuaccacgcaaacaacucaacagaacaaguggacacaauaauggagaaaaacgucaccgucacacacgcacaggacauacucgagaaaacacacaacggcaaacuaugcgaccuagacggcgucaaaccccucauacuacgcgacugcucagucgccggauggcuacucggaaacccuaugugugacgaauuuauuaacguacccgaauggucauacaucgucgaaaaagccaacccaguaaacgaccucugcuaccccggcgacuucaacgacuacgaagaacuaaaacaccuccuaucacgcaucaaucacuucgagaaaauccaaaucaucccaaaaagcagcugguccucccacgaagccucacucggggucucaagcgccugccccuaccaaggcaaauccucguucuuccgcaacgucgucuggcucaucaagaaaaacagcacauaccccaccaucaaacgaucauacaauaacaccaaccaagaagaccuccuaguccucuggggaauacaccaucccaacgacgcagccgaacaaacaaaacucuaccaaaaccccaccaccuacauaagcguaggcaccuccacccugaaccaacgccucgugccacggaucgcaacacgcuccaaagucaacggacagagcggacguauggaguucuucuggaccauccucaaacccaacgacgcaaucaacuucgaauccaacggcaacuucauagcaccggaauacgcauacaaaaucgucaagaaaggcgacagcaccaucaugaaaucagaacucgaauacgggaacugcaacaccaaaugccaaacaccuaugggcgccauaaacuccagcaugcccuuccacaacauccacccccucacaaucggcgaaugccccaaauacguaaaaucaaaccgccugguacuagcaaccgggcuacgaaacucaccacaacgcgaaacuagaggacucuucggcgcuauagcaggauucaucgaaggcggauggcaaggaauggucgacggaugguacggcuaccaccacuccaacgaacaaggcucaggauacgccgccgacaaagaauccacccaaaaagccaucgacggcguaaccaacaaaguaaacuccaucaucgacaaaaugaacacacaauucgaagccgucggcagagaguucaacaaccucgaacgccgcauugaaaaccuaaacaagaaaauggaagacggcuuccuugacguauggaccuacaacgcugaacuccucguccucauggaaaacgaacggacccucgacuuccacgacagcaacgucaaaaaccuguacgacaaaguccgccuacaacucagagacaacgcaaaagaacuagggaacggcugcuucgaguucuaccacaaaugcgacaacgaaugcauggaaucgguccgcaacggcaccuacgacuacccgcaauacucagaagaagcccgacucaaacgcgaagaaaucuccggcguaaaacucgaaucaaucggaaucuaccaaauacuaucgaucuacagcaccgucgcuagcagccuagcacucgccauaauggucgccggacucucacucuggaugugcuccaacggaucccuccaaugccgaaucugcauauaa

SEQ ID NO: 215663 - RNA, 1707 nt, Artificial Sequence
  derived and/or modified sequence opt from Influenza A H5N1 hemagglutinin
auggaaaaaaucguacuccucuucgcaaucguaucccuagucaaauccgaccaaaucugcaucggguaccacgcaaacaacucaaccgaacaaguugacaccaucauggagaagaacgucacagucacccacgcacaagauauucucgagaaaacccacaacggcaaacucugcgaccuagacggagucaaaccccucauccuccgagauugcuccguagcgggauggcuccuugguaaccccaugugcgacgaguucaucaacguaccagaaugguccuacaucguugaaaaggccaaccccguaaacgaccuaugcuaccccggagauuucaacgacuacgaggaacucaaacaccuacucucccgaauaaaccacuucgaaaaaauccagauaauacccaaauccuccuggucaucccacgaagccagccucggaguaucuuccgccugccccuaccaaggaaaguccucuuucuuccguaacgucgucuggcucaucaagaaaaacagcacauacccgaccauaaaacgcuccuacaacaacaccaaccaagaagaccuccucguacucugggggauccaccacccaaacgacgccgccgaacaaacgaaacuauaccaaaaccccacaaccuacauuagcguagguacauccacccuaaaccaacgccucguaccgcgaauagccacacgcucgaaagucaacggacagaguggccgaauggaauucuucuggaccauacucaaacccaacgacgcaauaaacuucgaaagcaacggcaacuucaucgcccccgaauacgcauacaagaucgucaaaaaaggcgacagcacaauuaugaaauccgaacucgaauacggcaacugcaacaccaagugccaaaccccaaugggagcaauaaacuccucaaugccguuccacaacauacacccccucacuauaggagaaugcccgaaguacguaaaaucaaaccgccucguccucgccaccggacuacgcaacucaccccaacgagaacgacgcaggaaaaaaagaggccuauucggcgcgauagccggcuucauagaaggaggcuggcaaggcaugguagacggcugguacggauaccaccacuccaacgaacaaggcucaggcuacgccgccgacaaagaaucaacucaaaaagccauagacggcgugaccaacaaagucaacagcaucaucgacaagaugaacacacaauuugaagcgguaggccgugaauucaacaaccuggaacgucgcaucgaaaaccucaacaaaaaaauggaagacggauuccucgacgucuggaccuacaacgcagaacuccuaguccuaauggaaaacgaacgcacccuagacuuccaugacuccaacgucaaaaaccucuacgacaaagucaggcuccagcuccgcgacaacgccaaagaauuaggcaacggcugcuucgaauucuaccacaaaugcgacaacgaaugcauggaauccguacgaaacggcacguacgacuacccccaauacuccgaagaagcccgccuaaaacgcgaagaaauaagcggagucaaacucgaaagcaucggcauuuaccaaauccuauccaucuacuccacagucgcguccucacucgcacucgccauaauggucgcaggccucagccuauggaugugcucuaacggaucacuccaaugccgcauuugcaucuaa

SEQ ID NO: 215664 - RNA, 1707 nt, Artificial Sequence
  derived and/or modified sequence opt from Influenza A H5N1 hemagglutinin
auggaaaaaaucguccuccucuuugccauagucucccuagucaagucagaccaaaucugcaucggauaccacgccaacaacucaaccgaacaaguagacacaaucauggagaaaaacgucaccgucacccacgcccaagacauacuggaaaaaacacacaacggcaaacuaugcgaucuggacggaguaaaaccgcuaauccuccgcgauugcucagucgcgggcuggcuccucggcaacccaaugugcgaugaauucaucaacguaccagaauggaguuauaucguggaaaaggcaaacccaguaaacgaccucugcuaccccggagacuucaacgacuacgaagaacuaaaacaccuacuaagccgcauaaaccacuucgaaaaaauccagauaauccccaaguccagcuggucaucccacgaggccucgcucggcgucuccuccgccugccccuaccaaggcaaaagcucauucuucaggaacgucguauggcucauaaaaaagaacagcaccuauccaaccauaaaacgaucguauaacaacaccaaccaggaagaccuccuuguccucuggggcauacaccaccccaacgacgccgcggaacagaccaaacuauaccaaaaccccacgaccuacauauccgucggcaccucaacccucaaccaaagacuagugccccgaaucgcaacacgcuccaaagugaacggccaauccggacgaauggaauucuucuggaccauccucaaaccuaacgacgccauaaacuucgagaguaacggaaacuucauagcaccagaauaugccuacaaaaucguuaaaaaaggagacuccacaaucaugaaauccgaacucgaauacggcaacugcaacaccaaaugccaaacacccaugggcgccauaaacuccucaaugcccuuccacaauauacacccccucacgaucggagaaugccccaaguacguaaaaucaaaccgccucguccucgcaacaggacuucgaaacuccccccaacgcgaacgccgacgcaaaaaacgcggccuauucggagccauugcuggcuucaucgaaggcggcuggcaaggcauggucgacggaugguacggcuaccaccacagcaacgaacaaggcuccggauacgcagccgacaaagaauccacccaaaaagcaaucgacgguguaacaaacaaagucaacuccaucauagacaaaaugaacacccaauucgaagccgucggcagagaauucaacaaccucgagcgcagaaucgaaaaccucaacaaaaaaauggaagacggauuccuagacguauggaccuacaacgccgaacuacuaguccugauggagaacgaacgcaccuuagacuuccacgacagcaauguaaaaaaccucuacgacaaagugcgccuacaacuccgcgacaacgcgaaagaauuaggcaacggcugcuucgaauucuaccacaaaugcgacaacgaaugcauggaaucaguccgcaacggcaccuacgacuacccccaauacagcgaagaagcacgacuaaaaagagaagaaaucucaggcgugaaacuagaaucaauagggauauaccaaauccucagcaucuacagcaccguagccagcagccucgcacucgcaaucauggucgcaggccucucccuguggaugugcuccaauggcucacuccaaugccgcaucugcaucuga

SEQ ID NO: 215665 - RNA, 1695 nt, Artificial Sequence
  derived and/or modified sequence opt from Influenza A H5N1 hemagglutinin
auggagaaaaucguccuccuguucgcuaucguuucucuagucaaguccgaccagaucugcaucggauaccacgccaacaacuccacagaacaagucgacacgauaauggaaaaaaacguuaccgucacacacgcacaagacauacuagaaaaaaaacacaacggcaaacuaugcgaccucgacggcguaaaaccccuuauacuccgcgacugcucagucgcaggcuggcuucucggcaacccaaugugcgacgaauucaucaacgucccggaauggagcuacaucgucgagaaagccaaucccgucaacgaccucugcuaccccggcgacuucaacgacuacgaagaacucaaacaccuacucagucgaaucaaccacuucgaaaaaauccaaaucaucccaaagucuuacugguccucccacgaagcaucccuaggcgucucaucagcaugccccuaccaaggaaaauccuccuucuuccgcaacgucgucuggcucaccaaaaaaaauucaaccuacccaaccaucaaacgauccuacaacaacaccaaucaagaagaccuccucguccuauggggcauccaccaccccaacgacgcagccgaacaaaccaaacucuaccagaacccaacaacauacauuuccguaggaacaagcacccucaaccaacgccucguaccccgcauagccacccggucgaaagucaacggccaauccggccgcauggaauucuucuggacaauccuaaaacccaacgacgccauaaacuucgaaagcaauggaaacuucaucgcucccgaauacgccuacaaaaucguaaaaaaaggcgauuccaccauaaugaaaucagaacucgaauacgggaacugcaacacaaaaugccaaacccccaugggagccaucaacucauccaugcccuuccacaacauucacccacuaacaaucggagaaugccccaaguacgucaaaucaaaccgacucguccuagccaccggacuccgcaauucaccccagcgcgaaacccggggacuguucggugccaucgcaggauucauugaaggcggauggcaaggcaugguagacggaugguacggauaucaccacuccaacgaacaaggauccggguacgccgcugacaaagaauccacacagaaagccaucgacggagucacaaacaaagucaacucuauaauagauaaaaugaacacacaauucgaggccgucggccgagaauucaacaaccuagaaagacguaucgagaaccucaacaaaaaaauggaagacggcuuccucgacguuuggaccuacaacgccgaacuacucguacuuauggaaaacgaacgcacccuagacuuccacgacucaaacguaaaaaaccucuacgacaaaguccgucuccaacucagagauaacgccaaagaacuaggaaacggaugcuucgaauucuaccacaagugugacaacgagugcauggaaaguguccgaaacggcaccuacgacuacccccaauacagcgaagaagcccgccuuaaacgagaagaaauauccggcgucaaacuugaauccauaggcaucuaccaaauccuauccaucuacucaaccguagccucaagucucgcccucgccaucauggucgcaggacuuagccuauggaugugcagcaacggcucacuacagugccgcauaugcauauaa

SEQ ID NO: 215666 - RNA, 1695 nt, Artificial Sequence
  derived and/or modified sequence opt from Influenza A H5N1 hemagglutinin
auggaaaagauaguacuacuauuugccauagucucccuuguaaaauccgaccaaaucugcauaggcuaccacgcaaacaacuccaccgaacaaguggacacaaucauggagaaaaacgucacagucacccacgcgcaagacauacucgaaaagaaacacaacggcaaauuaugcgaccuugacggcgucaaaccccucauccuccgcgauugcucagucgcaggauggcuccucggcaaccccaugugcgacgaguucauaaacgucccggaaugguccuacaucgucgaaaaagccaaccccgucaacgaccugugcuaccccggcgacuucaacgacuacgaagaacucaagcaccuucucucccgcaucaaccacuucgagaaaauacaaaucauccccaaauccuccugguccucacacgaggccagccuaggagucuccuccgccugcccauaucagggaaaauccuccuucuuucgcaacgucguauggcuaauuaagaaaaacucuacauacccaaccauaaaaggcagcuacaacaacaccaaccaggaagaccuccucguccuguggggcauccaccaccccaacgacgcagccgaacaaacuaaacuauaccaaaaccccacaacguacauauccgucggaacauccacccucaaccaacgccucgugccacgcaucgccacccgcuccaaagucaacggacaaagcggaagaauggaauuuuucuggacaauccucaaacccaacgacgccaucaacuucgaauccaacggcaacuucaucgccccagaauacgccuacaaaaucgucaagaaaggcgacagcaccaucaugaaaucagaacucgaauacggcaacugcaacaccaaaugccaaacaccaaugggcgccaucaacagcuccaugcccuuccacaacauccacccccucaccaucggcgagugccccaaauacguaaaaucaaacagacugguccuagccacaggccucagaaacagcccccaacgugaaacacgcggccuauucggcgcaaucgccggauucaucgaagggggcuggcaagguaugguagacggcugguacggauaccaccacuccaacgaacaaggaucaggauacgcagccgacaaagaaucaacacaaaaagccauugacggcgucaccaauaaagucaacucaauuauagacaaaaugaacacccaauucgaagccgucggccgggaguucaacaaccucgaacgccgcaucgaaaaccucaacaagaaaauggaagacggauuccuagacguguggacuuacaacgcagaacugcuaguccucauggaaaacgaacgcacccuggacuuccacgacuccaacgucaaaaaccuauacgacaaggucaggcuacaacuccgcgacaacgccaaagaacugggcaacgggugcuucgaguucuaccacaaaugugacaacgaaugcauggaaagcguccgaaacggcacauacgacuacccccaauacuccgaagaagcccgccucaaaagagaagaaaucuccggagucaagcucgaaaguaucggcaucuaccaaauccucuccaucuacagcacgguagcauccagccuagcacucgcaaucaugguggccggacucucgcucuggaugugcucgaacggcucgcuacaaugccgaaucugcaucuag

SEQ ID NO: 215667 - RNA, 1695 nt, Artificial Sequence
  derived and/or modified sequence opt from Influenza A H5N1 hemagglutinin
auggagaaaauaguccuccucuucgccauaguaucccuggucaaaucagaccagaucugcaucggauaccacgcaaacaacuccaccgaacagguugacaccaucauggagaaaaacgucaccgucacccacgcacaagauauccucgaaaagaaacacaacggcaaacuaugcgaccuagacggcguaaagccccuaauccuccgcgacugcucagucgccggguggcuccucggcaaccccaugugcgaugaguucauuaacgugcccgaaugguccuacaucguagaaaaagccaaucccguaaacgaccucugcuaccccggagacuuuaaugacuacgaagaacuaaaacaccuccucagccgaaucaaccacuucgaaaagauccaaaucauaccaaaaucauccugguccucccacgaagccucccuaggcgucagcagcgccugcccauaccaaggugaaagcucauucuuccgcaacgucguauggcuaaucaagaaaaacucaacuuacccgaccaucaaacgcagcuacaacaacacaaaccaagaagaucuccucguacucuggggaauacaccaccccaaugacgccgcggaacaaaccaaacucuaccaaaaccccaccaccuacaucuccgucggcaccagcacccucaaucaacgccuggucccacgcauagccacccgaucaaaaguaaacggccagagcggccgaauggaguucuucuggaccauacucaagcccaacgaugcaaucaacuucgaaucaaacggcaacuuuaucgcgcccgaguacgccuacaaaaucgucaagaaaggcgacucaaccauaaugaaaagcgagcucgaguacggcaacugcaacacaaaaugccaaacgcccaugggggccaucaacucaagcaugcccuuucacaacauccacccccuaacgauaggcgaaugcccgaaauacguaaaauccaacagacucgugcucgccacuggccuacgaaacucaccccaacgcgagacacgcggccucuucggcgccaucgccggcuucauagagggaggcuggcaaggcauggucgacggcugguacggcuaccaucacuccaacgaacaaggcucaggauaugcagcggacaaagaauccacccaaaaagccauagacggcguaacaaacaaggucaacucaauaaucgacaaaaugaacacacaauucgaagcagucggcagagaguucaacaaucuagaacgacggauagaaaaccugaacaagaaaauggaagacggcuuccuagacgucuggaccuacaacgcggaacuucugguccuaauggaaaacgaacgcacacucgacuuccacgauuccaacgugaaaaaccuauacgacaaaguccgccuccaauugagagacaacgcaaaagaacuugguaacggcugcuucgaguucuaccacaaaugcgacaacgaaugcauggaauccguccgcaacggcaccuacgacuacccacaauacucagaagaagcgcgccuaaaacgagaagaaaucagcggcgucaaacucgaaucaauaggaaucuaccaaauccuaucaauauacagcaccgucgcaagcucccuagcacucgccaucaugguggcgggccucagccucuggaugugcuccaacggaagccuccaaugccggaucugcaucuaa

SEQ ID NO: 215668 - RNA, 1695 nt, Artificial Sequence
  derived and/or modified sequence opt from Influenza A H5N1 hemagglutinin
auggaaaagaucguccuccucuucgccauagucucgcucguaaaaucagaccaaauaugcaucggauaccacgccaacaacucaaccgaacaagucgacacaauaauggagaaaaacgucaccguaacccacgcccaagacauccuggagaagaaacacaacggaaaacugugcgaccuagacggagucaaaccccucauacuaagagacugcucagucgccggcuggcuacuaggcaaccccaugugugacgaguucauaaacguuccagaaugguccuacauaguagaaaaagccaaccccgugaacgaccucugcuaccccggugacuucaaugacuacgaggaacucaaacaccuccucucccgcaucaaccacuucgagaaaauccaaaucauacccaaaucaucaugguccucccacgaagcaucccuaggcguaagcagcgccugcccauaccaaggcaagagcuccuucuuccgcaacgucgucuggcucaucgagaaaaacuccaccuaccccaccauuaaaaggucauacaacaacacaaaccaagaagaccuccucguccuuuggggcauccaccaccccaaugacgccgccgaacaaaccaaacucuaccaaaaccccacaacauacaucagcgucggcaccagcacccugaaccaacgccucgucccaaggaucgccacacgcuccaaaguuaacggccaguccggccguauggaguucuucuggaccauacucaaacccaacgacgcgauaaacuucgaauccaacggcaacuuuaucgcaccggaauacgccuacaaaaucgucaaaaagggcgacaguacaaucaugaaguccgaacuagaauacggaaacugcaacacaaaaugccaaaccccaaugggcgcaaucaacagcuccaugccauuccacaauauccacccacucaccaucggcgaaugcccaaaguacguaaaaaguaaccgccucguccuagccaccggacugcgcaacucaccucaacgcgaaacccgcggacuguucggcgcaaucgccggauucauagaaggcggauggcaaggaauggucgacggcugguacggcuaccaccacagcaacgaacaaggaucgggcuaugcggccgacaaagaaucgacacaaaaagcuaucgacggcgugacaaacaagguaaacagcauuauagacaaaaugaacacccaauucgaagcgguaggccgagaauuuaacaaccuagaacgccgcauagaaaaccuaaacaagaaaauggaggacggcuuccuagacguguggacauacaacgccgaacuccucguccucauggaaaacgaacgcacccucgacuuccacgacucaaacgugaaaaaccuauacgacaaaguacgacuccaacuacgagacaacgccaaagaacucggaaacggcugcuucgaauuuuaccacaaaugcgacaacgaaugcauggaaagcguccgcaacggcaccuacgacuacccacaauacagcgaagaagcccgcuuaaaaagagaagaaaucucgggcgucaagcucgaauccaucggaaucuaccaaauacucuccaucuacuccaccgucgccuccucccucgcccuggcaaucaugguagccggccucagccuauggaugugcuccaacggaucccuccagugccgcauuugcauauaa

SEQ ID NO: 215669 - RNA, 1695 nt, Artificial Sequence
  derived and/or modified sequence opt from Influenza A H5N1 hemagglutinin
auggagaaaauaguacuccuauucgcaauagucucccuaguaaaaucagaccaaaucugcaucggcuaccacgcuaacaacuccaccgaacaaguagacaccauaauggaaaagaacgucaccguuacgcacgcccaagacauccuagaaaagaaacacaacggcaaacugugcgaccucgacggcgucaaaccucuaauacuccgcgacugcuccgucgccggcuggcuccuaggcaaccccaugugcgaugaauuuaucaacgucccggaaugguccuacaucgucgaaaaagccaaucccgucaacgaccucugcuacccaggugacuucaacgacuacgaggaacucaaacaccuccuaagccgaaucaaccacuucgaaaagauacaaaucauccccaaaucauccuggagcucgcacgaagcgagccucgguguaucaagcgccugcccauaccaaggaaaaagcuccuucuuccgcaacgucgucuggcucaucaagaaaaauucagccuaccccaccaucaaaagguccuacaacaacaccaaccaggaagaccuccucgugcucuggggaauccaccauccaaacgacgccgccgaacaaaccgaacucuaccagaaccccacgacauacaucucaguaggcacauccacacuuaaccaacgacucgucccacgcaucgccacccgcucgaaagucaacggccaaucaggccgaauggaauuuuucuggacaauccuuaaacccaacgacgccauaaacuucgaauccaacggcaacuuuaucgccccagaauacgccuacaaaauaguaaagaaaggcgacucaacaaucaugaaaagcgaacucgaauacggaaacugcaacacaaaaugccaaacacccaugggagcgauaaauuccuccaugcccuuccacaacauccaccccuuaacgaucggagaaugcccaaaauacguaaaauccaaccgccuaguucucgccacuggccuccgaaacucuccucaacgcgaaacccgcggccuauucggcgccaucgccggguucaucgaagggggcuggcaaggaauggucgacggaugguacggcuaccaccacuccaacgaacaaggcucuggcuacgccgccgacaaagaauccacccaaaaagccaucgacggugucacaaacaaagucaauuccauaaucgacaaaaugaacacccaauucgaagcuguuggcagagaguucaauaaccucgaaagacgcauagaaaaccucaacaagaaaauggaagacggcuuucuagacgucuggacauacaacgcugaacuccucguucuaauggaaaacgaacgcacauuagacuuccacgacagcaacgucaaaaaucucuacgacaaaguccgacuacagcuacgcgacaacgccaaagaacuaggcaacggcugcuuugaguucuaccacaaaugcgacaacgaaugcauggaaucaguccgcaacggcaccuacgacuacccacaauacuccgaagaagcaagacuuaaacgcgaagaaaucuccggcgucaaacucgaauccaucggaaucuaccaaauacuguccauauacuccacagucgccagcucccuagcccuagccaucauggucgccggacucucccuuuggaugugcucgaacggaucccuacaaugccgcauaugcaucuaa

SEQ ID NO: 215670 - RNA, 1695 nt, Artificial Sequence
  derived and/or modified sequence opt from Influenza A H5N1 hemagglutinin
auggaaaagaucguccuucucuucgccauaguaucccucguaaaaagcgaucaaaucugcauaggauaccacgcaaacaacagcacugaacaagucgacacgaucauggagaaaaacgucacaguaacccacgcccaggacauccucgaaaagaaacacaauggcaaacucugcgaccuagacggcguaaaaccccuaauccuacgcgacugcucggucgccggcuggcuccucggcaaccccaugugcgacgaauuuaucaacgugccagagugguccuacaucgucgaaaaagccaaccccgucaacgaccucugcuaccccggcgacuucaacgacuacgaagaacuaaaacaccuccuaucacgcaucaaccacuucgaaaagauucaaauaauacccaaaaguucaugguccucccacgaagccagccugggagucuccuccgccugcccauaccaaggcaaauucuccuucuuccgcaacgucguuuggcucaucaagaaaaauuccacuuacccaaccaucaaaagauccuacaacaacaccaaccaagaagaccuccuaguccuauggggaauccaccacccgaacgacgcggccgagcaaaccaaacucuaccaaaaccccaccacauacaucagcguaggaacauccacccucaaccaacgacucgucccgcgcaucgccacccgaagcaaaguaaacggccagucgggccgcauggaguucuucuggaccauccugaaacccaacgacgcaauaaacuucgaaucaaacggcaacuucaucgcacccgaauacgcauacaaaaucgucaagaaaggcgacucgacaaucaugaaauccgaacuagaauacggaaacuguaacaccaagugccaaacacccaugggagcaaucaacucauccaugccguuccacaacauccacccccucacaauaggcgaaugccccaaauacgucaagucaaaccgccucguccucgccacaggccuuagaaacagcccccaacgagaaacccgaggccuguucggugccauagccggcuucaucgaagggggauggcaaggcauggucgacggaugguacggauaccaccacuccaacgaacaaggcuccggcuaugccgccgacaaagaauccacccaaaaagccauagacggagucaccaacaagguaaacucaaucauagacaaaaugaauacccaguucgaagccguaggacgagaguucaacaaccucgaaagacgaauugaaaaccucaacaagaaaauggaagacggcuuccucgaugucuggaccuacaacgcugaacuacucgugcucauggaaaacgaacgaacccucgacuuccacgacagcaacgucaaaaacuuauacgacaaaguacgccuccaacuacgcgacaacgccaaagaacuaggaaacggcugcuucgaguucuaccacaaaugcgacaacgaaugcauggaaucaguaagaaacggcaccuacgacuacccccaguacuccgaagaagccagacuuaaaagagaagaaaucuccggcguaaaacuagaaagcaucggcauauaccaaauacucucgauauacuccaccguagccuccucccucgcacuagcaaucauggucgccggucucucacuauggaugugcucgaacggcucacuccaaugccgcaucugcaucuaa

SEQ ID NO: 215671 - RNA, 1695 nt, Artificial Sequence
  derived and/or modified sequence opt from Influenza A H5N1 hemagglutinin
auggaaaaaaucguccuccucuucgcaaucgucagccuagucaaaagcgaccagaucugcauaggauaccacgccaacaacagcaccgaacaagucgacaccaucauggaaaaaaacgucaccgucacacacgcccaagacauacuagaaaaaaaacacaacggaaaacuaugcgaccuagacggcgucaaaccccuaauccugcgcgacugcucagucgcaggauggcuccucggaaaccccaugugugacgaauucaucaacgucccagaaugguccuacaucguagaaaaagccaaccccguaaacgaccucugcuaccccggagacuucaacgauuacgaggaacuaaaacaccuccuaucccgcaucaaccacuucgaaaaaauccaaauaauacccaaaucauccugguccucccacgaagccucauuagggguaagcucagccugcccauaccaaggcaaaucaucguucuuccgcaacgucguauggcuaaucaaaaaaaacagcacauacccaaccaucaaacgaucauacaacaacaccaaccaagaagaccuacucguccuauggggcauccaccaccccaacaacgcugcggaacaaaccgagcuguaccaaaacccgacgaccuauaucagcguuggaacaucuacccuuaaccaacgucuaguacccagaaucgcuacacgaagcaaagucaacggccaaucaggccgcauggaguucuuuuggaccauccuaaaacccaacgacgccaucaacuucgaguccaacggcaacuucaucgcccccgaauaugccuacaaaaucgucaaaaaaggagacucaaccaucaugaaaagcgaacuagaauacggaaacugcaacaccaaaugccaaaccccaaugggcgccaucaacucuuccaugccguuucacaacauccacccacucaccauaggagaaugccccaaauacguaaaaucaaaccgccucguccuggcaaccggacuacgaaacuccccccaacgcgaaacccgcggccuauucggcgccauagcaggcuucaucgaagggggcuggcaaggaaugguagacggaugguacggcuaccaccacagcaacgagcaaggcagcggguacgccgcagacaaggaauccacccaaaaggccaucgacggcgucacaaacaaagucaacucaaucauugacaaaaugaacacccaguucgaagccguaggccgcgaguucaacaaccucgaacgacgcaucgagaaccucaacaaaaagauggaagacggauuccuagacguauggaccuacaacgcagaacuccuaguccucauggaaaacgaaagaacucucgacuuccacgacuccaacguaaaaaaccucuacgauaaaguccgccuacagcugagagacaacgccaaagaacucgguaauggcugcuucgaauucuaccacaaaugcgacaaugaaugcauggaaucgguacgcaacggaacauacgacuacccgcaauacucagaagaagcgcgccucaaacgcgaagaaauaagcggcgucaaacucgaguccaucgggauauaccaaauccuaagcaucuacucaacaguggccucuucacuggcacuagcaaucaugguugccggccucucccuauggaugugcuccaacggaucccuccagugucguaucugcauauga

SEQ ID NO: 215672 - RNA, 1695 nt, Artificial Sequence
  derived and/or modified sequence opt from Influenza A H5N1 hemagglutinin
auggagaaaauaguacuccucuucgcgauagucucccucgucaaaucagaccaaaucugcaucggauaucacgccaacaacucaaccgaacaaguagacaccauaauggagaaaaacgugacaguaacacaugcccaagacauccuggaaaagaaacacaacggcaaacucugcgaccuggacggcguaaaaccacuaauccuccgagacugcucaguagccggcuggcuccucggcaacccaaugugcgacgaguucauaaacguacccgaauggagcuacaucguggaaaaagcaaacccaguaaacgaccucugcuacccgggagacuucaacgacuacgaagaacucaaacaccuccuaucccgcauaaaccacuucgagaaaauccaaauaauccccaaauccagcuggagcucccacgaagcaucccucggcguaucuuccgcaugcccauaccaaggcaaaccaucauucuuccgaaacgugguguggcuaaucaagaaaaacuccaccuaccccaccauaaaaagaagcuacaacaacaccaaccaagaagaccugcugguacuauggggcauccaccaccccaacgacgcagccgaacaaacaaaacuauaccagaacccaaccacguacauuuccgucggcaccucgacccucaaccaacgccuaguuccgcgaaucgccacaagaagcaaagucaacggccagagcggcagaauggaguucuucuggacaauccucaaacccaacgaugcgaucaacuucgaaagcaacggcaacuucaucgcaccggaauacgcguacaaaaucgucaagaaaggagacagcacuaucaugaaaagcgaacucgaauacggcaacugcaacacaaaaugccaaacccccaugggggccaucaacagcucgaugcccuuccacaacauccacccgcuaacaaucggagaaugcccaaaauacgucaaaagcaaccgacucguacucgccacaggccuccgcaacagcccccaacgcgaaacaagaggccuauucggcgcaaucgccggauucauagaaggcggauggcaaggcaugguagacggcugguacggcuaccaccacagcaacgaacagggcuccggauacgcagccgacaaagaauccacccaaaaagccaucgacggagucaccaacaaagucaacucaauuaucgacaaaaugaacacccaauucgaagcagugggccgugaauuuaacaaccucgaaagacgcauagaaaacuugaacaagaaaauggaagacggcuuccuggacgucuggaccuacaacgccgaacuacucguucugauggaaaacgaacgcacucuggacuuccacgacagcaacgucaaaaaccucuacgacaaagucagacuccaacuccgagacaacgcuaaagaacucggaaacggaugcuucgaguucuaccacaaaugcgacaacgaaugcauggaaagcguccgcaacggcaccuacgacuacccacaguacucagaagaagcccgacuaaaacgagaagagauauccggagucaaacuagagucgaucggcaucuaccaaauacucuccaucuacagcaccgucgccagcucgcuagcccucgccauaauggucgcaggacucucgcucuggaugugcuccaacggaucacuccaaugccgcauaugcauauaa

SEQ ID NO: 215673 - RNA, 1695 nt, Artificial Sequence
  derived and/or modified sequence opt from Influenza A H5N1 hemagglutinin
auggaaaagauaguccuccuguucgccauagucucccucguaaaauccgaccaaaucugcaucggcuaccacgcaaacaacucaacugaacaagucgauaccauaauggaaaaaaacguaaccgugacccacgcccaagacauccucgagaaaaaacacaacggaaagcucugcgaccuagauggagucaaaccccuaauccuccgcgacugcagcguagccggcuggcuucucggcaaccccaugugcgacgaguucauuaacguccccgaauggucauacaucgucgaaaaagccaaccccguaaacgaccuaugcuaccccggcgauuucaacgacuacgaagagcuuaaacaccucuuaucccgcauaaaccauuucgaaaaaauccaaaucauacccaaaucauccugguccucccacgaggcaucacuaggaguauccagcgcaugccccuaccaagaaaaauccagcuucuuccgcaacgucgucuggcuaauuaaaaaaaacuccaccuaccccacaauaaaacgguccuacaacaacaccaaccaagaagaucuccuaguccucuggggcauacaccaccccaacgacgccgcugaacaaacgaaacuauaccaaaacccaaccacguauaucuccguaggcacaucaacccucaaccagcgccuaguaccccgcaucgccaccagauccaaagucaacggacaaagcggcagaauggaauucuucuggacaauccuaaagccaaacgacgccaucaacuuugaauccaacggaaacuucaucgcccccgaguacgccuacaaaaucguaaaaaaaggcgacuccaccauaaugaaaagugagcucgaauacggcaacugcaacacaaaaugccaaacccccaugggcgcgaucaacagcucaaugcccuuccacaacauacacccacucacaauuggagagugccccaaauacgucaaauccaaccgacuaguccucgcgacaggacuccgaaacagcccacaacgcgagacaagaggacucuucggagcaaucgccggauucaucgaaggaggcuggcagggcauggucgacgggugguacggcuaucaccacuccaacgagcaaggaagcggcuacgcagccgacaaagaauccacccaaaaagccaucgacggcgucaccaacaaaguaaacuccaucauagacaaaaugaacacacaauucgaggccgucggacgagaguuuaacaaucucgaacgccggauagaaaaccucaacaaaaaaauggaggacggcuuccucgacguauggacauacaaugccgaacugcucguccuaauggaaaacgaacggacacucgacuuccacgacuccaacguaaaaaaccucuacgacaaagugcgacuacaacuccgcgacaacgcgaaagaacuaggaaacgggugcuucgaauucuaccacaagugcgacaacgagugcauggaaagcguccgcaacggaaccuacgacuacccgcaguacucagaagaagcgcgccucaaacgugaggaaaucuccggaguaaaacucgaauccaucggaaucuaccaaauccucucaaucuauucuaccgucgcaagcucccuagcacuagccaucaugguagcaggacucucacuauggaugugcuccaacggcagucuccaaugccgcauaugcaucuaa

SEQ ID NO: 215674 - RNA, 1695 nt, Artificial Sequence
  derived and/or modified sequence opt from Influenza A H5N1 hemagglutinin
auggaaaaaauaguccuccuguucgccaucgucagccucguaaaaagcgaccaaaucugcauaggcuaccacgcaaacaacuccacagaacaagucgacacaauaauggagaaaaacguuaccgucacccacgcccaggacauacuagaaaaaaagcacaacgguaaacucugcgaucuagacggagucaaaccccuaauccuccgcgacuguuccguagccggcuggcuucucgggaaccccaugugcgacgaauucaucaacgucccagaguggagcuacauugucgagaaagcaaacccaguaaaugaccucugcuaccccggugacuucaacgacuacgaagaacuaaaacaucuccucucccgcauaaaccacuucgaaaaaauacagauaaucccaaaauccuccugguccucccacgaagccucacuaggcguauccuccgccugccccuaccaaggcaaauccagcuucuuccgaaacgucguauggcucauaaacaaaaacucaaccuacccaaccauaaaacgcuccuauaacaacaccaaucaagaagaccucuuaguccucuggggaauacaccacccaaacgacgccgccgagcaaaccaagcucuaccaaaacccuaccacauacauauccgucggaaccagcacccucaaccaacgacuugucccccgaauagccaccagauccaaagucaacggccaaucgggccgcauggaauucuucuggacaauucucaaaccuaacgacgccauaaacuucgaguccaacggcaacuucaucgcccccgaauacgccuacaaaauagugaaaaaaggagacuccaccauuaugaaauccgagcucgaauacggaaacugcaacacaaagugccaaacccccaugggagccaucaauucaagcaugcccuuccacaacauccacccccugaccauaggcgaaugccccaaauacgucaaaucaaaccgccucguccuagccaccggacuccgcaacucaccccaacgcgaaaccagaggccuauucggcgccaucgccggcuucaucgaaggaggauggcaaggcauggucgacggcugguacggguaccaccauuccaacgaacaaggaucaggcuacgccgcagacaaagaaagcacccaaaaagccaucgacggcgucaccaacaaagucaacuccauaauagacaaaaugaacacccaauucgaagccguaggccgcgaauucaacaaccucgagcguagaauagaaaaccuuaacaaaaaaauggaagacggcuuccucgacguauggaccuacaacgcggaacugcuaguccucauggaaaacgaacgcacccuagacuuccacgacucaaacgucaaaaaccuguacgacaaaguccgccuccaacuccgagauaacgcaaaagaacucggcaacggaugcuucgaauucuaccacaaaugcgacaacgaaugcauggaaagcguccgaaacggcaccuacgacuacccccaauacuccgaagaggcacgccucaaacgcgaagaaaucuccggcgucaaacuagaauccaucggcaucuaccaaauccuauccaucuacuccaccgucgcauccucccucgcuuuggccauaauggucgccggccuauccuuauggaugugcucgaauggcucccuccaaugccgcaucugcaucuaa

SEQ ID NO: 215675 - RNA, 1695 nt, Artificial Sequence
  derived and/or modified sequence opt from Influenza A H5N1 hemagglutinin
auggaaaagaucguccuccuguucgcaaucgucucacuugucaaaagcgaccaaauaugcaucggauaccacgcaaacaacagcaccgaacagguugacaccaucauggaaaagaacguaacagucacccacgcacaagacauccuagaaaagaaacacaacggaaaacuaugcgacuuagacggcgugaaaccccucauccuccgcgacugcuccguagcaggcuggcugcuagguaacccgaugugcgacgaguucaucaacgucccagaguggagcuacauagucgaaaaagcaaaccccguuaacgaccucugcuacccaggagacuucaacgacuacgaagaacugaaacaccuacucagcagaauuaaccacuucgagaaaauccaaaucauaccuaaaagcagcuggagcucccacgaagccucccucggcgucagcuccgcgugcccauaccaaggaaaauccucauucuucagaaacgucguauggcucauaaagaaaaacucaaccuacccaaccaucaaacgcucauauaacaacacaaaccaagaagaccugcugguccucuggggcauccaccacccaaacgacgccgccgaacaaaccaaacuguaccaaaaccccaccacauacaucucagucggcacaagcacauuaaaccaacgccuaguccccagaauagcaacccgaagcaaagucaacggucaaagcggacgcauggaguucuucuggaccauccucaaacccaacgacgccauaaacuucgaaucaaacggaaacuucaucgcacccgaauacgcauacaaaauagucaagaaaggagacucaacaaucaugaaaucagaacuggaauacggcaacugcaacaccaaaugucaaaccccgaugggcgccauaaacucaucaaugccauuccacaacauccacccccucacaaucggagaaugcccaaaauacguaaaauccaaccgacucguccucgccacaggccuccgaaacuccccacaacgagaaacccgcggccuuuucggcgcaaucgcgggcuucaucgaaggcggcuggcagggcauggucgacggaugguacggauaccaccacuccaacgagcaaggcagcgguuacgccgcagacaaggaauccacacaaaaagccaucgacggagucacaaacaaggucaacuccaucaucgacaaaaugaacacacaauucgaagccgucggacgagaauuuaauaaccucgaacgccgcauagaaaaccucaacaaaaagauggaagauggcuuccucgacgucuggaccuacaacgcagaacuacugguccucauggaaaacgaacgcacccucgacuuccacgacagcaaugucaagaaccuauacgacaaaguacgacuacaacuccgcgacaacgccaaagaacuaggcaacggauguuucgaguucuaccacaaaugcgacaacgaaugcauggaaucaguccgcaacgggacauacgacuacccccaauacucagaagaagcccgccuaaaacgagaagaaauauccggcgucaaacucgaauccaucggcaucuaccaaauacuauccaucuacuccacggucgccucaucacucgcccuagcaauaauggucgcaggacucucccucuggaugugcuccaacggcucacuccaaugccguaucugcaucuag

SEQ ID NO: 215676 - RNA, 1683 nt, Artificial Sequence
  derived and/or modified sequence opt from Influenza A H7N9 hemagglutinin
augaacacccaaauccuaguauucgcacuaaucgccaucauucccacaaacgccgacaaaaucugccuaggacaccacgccgucagcaacggcaccaaagugaacacgcucaccgaacgaggcgucgaagucgucaacgccaccgaaacagucgaacgcaccaacaucccccgaaucugcagcaaaggcaaacgcacugucgaccuaggccaaugcggacuacucggaaccaucaccgggcccccgcaaugcgaccaguuucuggaguucagcgcagacuuaaucauagaaagaagagaaggaucugacgugugcuacccuggcaaauuugucaacgaagaagcccuccgacaaauccuacgagaaagcggcggaauagacaaagaagccaugggcuucacauauucagggauccgaacaaacggagcaaccagcgccugucgccgcucaggcucaaguuucuacgcggaaaugaaauggcuccuaucaaacaccgacaacgccgcauucccccaaaugacaaaaucuuacaaaaacacccgaaaaagccccgcacucaucgucugggggauccaucauuccguaucaaccgccgaacaaaccaaacuuuacggaagcggcaacaagcuaguaacaguaggcagcagcaacuaccaacaguccuucguccccagccccggcgcccgaccgcaagucaacggccucuccggccgcaucgacuuccacuggcuuaugcucaacccaaacgacacaguaacauucagcuucaacggcgcauucaucgcaccagaccgcgccuccuuccucagaggcaaaucaauggguauccaauccggcgugcaagucgacgccaacugcgaaggggacugcuaccacuccggaggaacgaucaucuccaaccuaccauuccaaaacaucgacucccgcgcaguaggaaaaugcccacgcuacgugaaacaacgaucacuacuacuagccaccggcaugaaaaacgucccagaaaucccgaaaggacgcggccucuucggcgccaucgcaggcuucauagaaaacgguugggaaggcuuaauagacggcugguacggcuuccgccaccaaaacgcccaaggcgaaggcaccgccgcagacuacaaaagcacccaaucggccaucgaccaaaucacgggcaaacucaaccgccuuauagagaaaacaaaccaacaauucgaacucaucgacaacgaguucaacgaaguagaaaaacaaaucggaaacgucauaaacuggacccgagacucgauaaccgaaguguggucauacaacgccgaacuccuaguagccauggaaaaccagcacacaaucgaccucgccgacagcgaaauggacaaacuauacgaacgagucaagcgacaacuacgcgaaaacgcggaagaagacggcacaggcugcuucgaaaucuuccacaagugcgacgacgacugcauggccucaauccgaaacaacacauacgaccacagcaaguaccgcgaagaagccaugcagaaccgcauccaaauugaccccgucaaacucagcagcggguacaaagacgugauacuaugguucucauucggcgcaagcugcuucauccuacucgccaucguaaugggucuaguguucaucugugucaaaaacggcaacaugcgcugcacgaucugcaucuaa

SEQ ID NO: 215677 - RNA, 1701 nt, Artificial Sequence
  derived and/or modified sequence opt from Influenza A H1N1 hemagglutinin
augaaagcaauacucgucguacuccuauacaccuucaccacagcaaacgcggacacccuaugcaucggcuaccacgccaacaacuccaccgacaccguggacaccgucuuagagaaaaacguaaccgucacacacagcgucaaccuccucgaaaaccggcacaacggcaaacuuugcaaacuccgcggcgucgcaccccuucaccugggcaaaugcaacauugcaggcuggcuacucggcaaccccgaaugcgaaucccucuccacagccagcagcugguccuacaucguagaaaccagcaacuccgacaacgguacaugcuaccccggcgauuucauaaacuacgaagaacuaagagaacagcucuccuccgucuccuccuucgaacgcuucgaaauauucccaaaaacaagcucguggcccaaccacgacaccaaccgcggcgucaccgcggccuguccacacgccggagccaacagcuucuaccgcaaccuagucuggcucgucaagaaagguaacuccuacccaaaaaucaacaaaucauacaucaacaacaaagaaaaagagguccucguccuaugggccauccaccaccccagcaccucagccgaccaacaaucacuuuaccagaacgccgacgccuacgucuucgucggauccucccgcuacucccgcaaauucgaaccggaaaucgccacacgaccaaaaguccgcgaccaagccggacgcaugaacuacuacuggacgcucgucgaacccggagacaaaauaaccuucgaagccaccggaaaccuagucgcccccagguacgccuucgcacucaaacgaaacagcggcuccggcauaaucaucagugacacaagcguccacgacugugacacaaccugccaaacccccaacggggcaaucaacaccagccuccccuuccaaaacauucaccccguaaccauaggcgagugccccaaauacgucaaauccacgaaacuccgaauggccacaggccuucgaaacauccccuccauccaaucccguggacucuucggcgcaauagcaggauuuaucgagggcggauggacgggcaugaucgacggaugguacggguaccaccaccaaaacgaacaaggcuccggcuaugcugcagaccuaaaguccacccaaaacgccaucgacgggaucaccaauaaagucaacuccguaaucgagaaaaugaacacgcaauucaccgccgucggaaaagaguucucacaccuugaacggcgaauagaaaaccuaaacaagaaagucgacgacggauuccucgacaucuggacauacaacgccgaacucuuaguccugcucgaaaacgaacgcacacucgacuaccacgacucaaacgucaaaaaccucuacgaaaaaguucgcagccaacucaaaaacaacgcuaaagaaaucggaaacggcugcuucgaguucuaccacaaaugcgacgacaugugcauggaauccgucaaaaacggaacauacgacuacccaaaauacucagaagaagcuaaacuaaaccgcgaagaaauagacggagucaaacucgaauccacacguauauaccaaauccuggccaucuacuccaccgucgcaucaagccugguccucgucgugucccucggagcgaucucauucuggauguguuccaacggcucccuacagugccgcauuugcaucuaa

SEQ ID NO: 215678 - RNA, 1701 nt, Artificial Sequence
  derived and/or modified sequence opt from Influenza A H1N1 hemagglutinin
augaaagcaauccuggucguacuucucuacacguucgccaccgccaacgccgacacacucugcaucggauaccacgcaaacaacagcacagacaccguagacaccguccuggagaaaaacguaaccgucacucacagcguaaaccuccuagaagacaagcacaacggcaaacugugcaaacuccgaggggucgcgccccuacaccucggaaaaugcaacaucgccggcuggauacucggcaaccccgaaugcgaaagucuauccacagcauccagcugguccuacaucguagaaacguccuccuccgacaacgggaccugcuaccccggcgacuucaucgacuacgaagaacuaagagaacaacugaguagcgucuccucauucgaacgcuucgaaauauuuccaaaaaccagcuccuggcccgaccacgacuccaacaaaggcguaaccgccgccugcccccacgcuggcgccaaauccuucuacaaaaaccuaaucuggcuagucaagaaaggcaacuccuacccaaaacuaucaaaaagcuacaucaacgacaaaggaaaagagguacucguacuuugggguauccaccacccaucaacaagcgccgaccaacaaagccucuaucaaaacgccgacgcguacguauucgucggaaccucccgauacuccaagaaauucaaaccggaaaucgcuauccggcccaaaguucgcgaccaagaaggccgaaugaacuacuacuggacccuugucgaacccggcgacaaaaucaccuucgaagcaacaggcaaccuagucgucccacgauacgccuucgccauggaacgaaacgcaggcucuggaaucaucauaucagacacacccguacacgacuguaacacaacaugccagaccccaaaaggcgccaucaacacaucacuaccauuccaaaauauacacccaaucaccauagggaaaugcccaaaauacgucaaauccaccaaacuccggcuugccaccggccuaagaaacguacccuccauacaaagccguggccuauucggugccaucgcaggcuucaucgaagguggcuggacaggaauggucgacggcugguacggauaccaccaccaaaacgaacaaggcuccgguuacgccgcagaccucaaaucaacacaaaacgccaucgauaaaauaaccaacaaaguaaacagcgucaucgagaaaaugaacacccaauucaccgccgucggcaaagaguucaaccaccucgaaaaacgaaucgaaaaccucaacaagaaagucgacgacggcuuccucgauaucuggaccuacaacgcagaacuacucguccuccucgagaacgaacgcacacucgacuaccacgacucaaacguaaagaaccuauacgaaaaaguacgaucacaacucaaaaacaacgcaaaagaaaucggcaacggcugcuucgaguuuuaccacaaaugugacaauaccugcauggaaagcgucaaaaacggcaccuacgacuaccccaaauacagcgaagaggccaaacucaaccgcgaggagauagacggcguaaaacucgagagcacacgaaucuaccaaauacuagcaauuuacuccacagucgcauccucccuaguccuggugguaagucuaggagccaucagcuucuggaugugcuccaacggcucacuccagugccgcaucugcaucuag

SEQ ID NO: 215679 - RNA, 1701 nt, Artificial Sequence
  derived and/or modified sequence opt from Influenza A H1N1 hemagglutinin
augaaagccauccuagucguacuacucuacacguucgccaccgcaaacgcagacacccucugcauaggcuaccacgcaaacaacuccaccgacaccguggacacaguccuugagaaaaacguaaccguaacccacucaguaaaccuccucgaagauaaacacaacggcaaacuauguaaacuacgcggaguggcaccccuacaccuaggcaaaugcaacaucgccggcuggauacucggcaacccagaaugcgaaucccuguccaccgccucauccugguccuacaucgucgaaacuuccuccagcgacaacggaaccugcuaccccggggacuucaucgacuacgaggaacuacgcgaacagcucuccagcguuuccucauucgaacgcuucgaaauauuccccaaaaccagcuccuggcccgaccacgaaucaaacaagggaguaaccgccgccugcccccacgccggagccaaauccuucuacaaaaaccucaucuggcuaguaaagaaaggcaacagcuaccccaaacucucuaaaucguacauaaacgacaaagguaaagaaguccucguacuauggggaauacaccacccuagcaccuccgccgaucaacaaucccucuaccaaaacgcagacgcuuacgucuucgucggaaccucacgcuacuccaagaaauucaaaccagaaauagccauccgcccuaaaguccgcgaccaggaaggccgcaugaacuacuacuggacucucguagaaccaggagacaaaaucaccuucgaagcaaccggcaaccucguggucccacgcuacgccuucgcgauggaacgaaacgcuggauccggcaucaucaucucagacacccccguacacgacugcaacaccacaugucaaacccccaaaggcgccauaaauacaucccuacccuuccaaaacauccaccccaucaccaucggcaaaugccccaaauacguaaaauccacaaaacugcgacucgccaccggccuccgaaacguacccuccauccaaucccgcggacucuucggcgccaucgccggauuuaucgaaggcggcuggacaggcauggucgauggaugguacggauaccaucaccaaaacgaacaaggcagcggcuacgccgccgaccucaaaagcacacaaaacgccauagacaaaauaaccaacaaagucaacagcgucaucgagaaaaugaacacccaauucacagccgucgguaaagaguucaaccaccucgaaaaacgcauugaaaaccuaaacaagaaagucgacgacggcuuccuagauaucuggaccuacaaugccgaacuccuaguacuacuagaaaacgaacgcacgcucgauuaucacgacucgaacguaaagaaccucuacgaaaaaguacgaucccaacucaaaaacaacgccaaagaaauaggcaacggcugcuucgaguucuaucacaaaugcgacaauaccugcauggaaucagucaaaaacggcaccuacgacuacccaaaauacuccgaagaagccaaacucaaccgagaagaaaucgacggcguaaaacuggaaagcacccgaaucuaccaaauccucgcuaucuacucgacagucgcuuccucccuaguccucgucguaucacuuggcgccaucucauucuggaugugcuccaacggcucccuccaaugccgaauuuguaucuaa

SEQ ID NO: 215680 - RNA, 1701 nt, Artificial Sequence
  derived and/or modified sequence opt from Influenza A H1N1 hemagglutinin
augaaagccaucuuagucguccuccucuacaccuucgcaaccgcaaacgccgacacgcucugcaucggcuaccacgcaaauaacucaacagacacaguagacacagugcuugagaaaaacgucaccgucacccacagcgucaaccuacucgaagacaagcacaacggcaaacuuugcaaauuacgcggcguugcccccuuacaccugggcaaaugcaacaucgcgggcuggauccucggcaaccccgaaugcgaaagccuauccacugccucguccuggucauacaucguugaaacacccuccuccgacaacgguaccugcuacccaggcgacuucauagacuacgaagaacuccgugaacaacucuccagcguauccuccuucgaacgguucgaaaucuuccccaaaaccucaucauggcccaaccacgacuccaacaaaggaguaaccgccgccugcccccacgccggugccaaguccuucuacaaaaaccucaucuggcuagucaagaaaggcaacucuuaccccaaacucucaaaauccuacauaaacgacaaaggcaaagaaguccucguccuuugggggauucaccacccacccacauccgcggaccaacaaucacucuaccaaaacgcagacaccuacguauucgucggaagcucccgauauuccaagaaauucaaaccagaaaucgccauccgacccaaagucagagaccaagaaggcagaaugaauuacuacuggacauuagucgagccaggcgacaaaaucaccuucgaagcaaccggaaaccucgucguccccagauacgccuucgccauggaacgaaacgcaggauccggcauaaucauaucugacacacccguccacgacugcaacaccacuugccaaacaccaaaaggcgccaucaacaccagccuccccuuccaaaacauccaccccaucaccauaggaaaaugcccaaaauacguaaagagcaccaaacuccgccuggccaccggccugcgaaacaucccaucaauccaaagccgcggccuauucggcgccaucgcaggcuucaucgagggaggcuggaccggcaugguagacggaugguacggcuaccaccaccaaaacgaacaaggauccggauacgcagcggaccucaaauccacccaaaacgcaaucgacgaaaucaccaacaaaguaaacuccgugaucgagaaaaugaacacacaauucaccgccgucggaaaagaguucaaccaccuagaaaaacggauugaaaaccucaacaaaaagguagacgacggauuccucgacaucuggaccuacaacgcggaacuccucgucuuacuugaaaaugaacgcacgcuggacuaucacgacuccaacgucaagaaccuauacgaaaaagucaggucccagcucaaaaacaacgccaaggaaaucggaaacggcugcuucgaguucuaccacaaaugcgacaacacaugcauggaaagcgucaaaaacggcaccuacgacuaccccaaauacuccgaagaagcaaagcuaaaccgcgaagaaaucgacggagucaaacucgaauccacccgcaucuaccagauccucgccauauacuccacagucgccuccucccuaguccuagucguaucacucggcgccaucucauucuggaugugcagcaacgggagucuccagugcaggaucuguaucuaa

SEQ ID NO: 215681 - RNA, 1701 nt, Artificial Sequence
  derived and/or modified sequence opt from Influenza A H1N1 hemagglutinin
augaaagccauccucgucguccuacucuacacguucgccaccgccaacgccgacacucuaugcaucggcuaccacgccaacaacuccacagacaccgucgacaccguacucgagaaaaacgucaccgucacccacagcgucaaccuacucgaagacaaacacaacggcaaacucugcaaacuucgcggagucgcaccacuacaccuaggcaaaugcaacaucgccggcuggauccuagggaaccccgaaugcgaaucacucucaacggccucgagcuggagcuacaucguggaaaccccauccagcgauaacggaaccugcuaccccggcgacuuuauagacuacgaggagcucagagaacaacucuccagcguaucauccuucgaacgcuucgagaucuuccccaaaaccagcagcuggccaaaccaugacucaaacaaaggcguaacagccgccugcccccacgccggcgccaaguccuucuacaaaaaucuaaucuggcucgucaagaaaggaaauagcuaccccaaacucuccaaaucguacaucaacgacaaaggcaaagaaguacugguccucuggggaauacaccacccaucgaccuccgcagaccaacaauccaucuaucaaaacgcagacaccuacguuuucguaggcucgucccgcuacucaaagaaauucaaacccgagaucgcaaucagaccgaaagucagagaccaagaaggccgcaugaacuacuacuggacccucguagaacccggagacaaaaucacauucgaagcaacaggaaaccucgucguccccagauacgcauucgcaauggagcgaaacgccggauccggcaucaucauuucagacacucccgugcacgauugcaacacaaccugccaaacccccaaaggcgcuaucaacaccucccuacccuuccaaaacauccaccccaucaccaucgggaaaugccccaaauacguaaaaaguacaaaacugagacucgccacaggacugcgaaacauccccucuauccaaucccgcggacucuucggagcaaucgcgggauucaucgaaggcggguggacuggcaugguagacggcugguacggcuaccaccaccaaaacgaacaaggaagcggauacgcagccgaccucaaauccacccaaaacgccauagacgaaauaacaaacaaagucaacuccguaaucgaaaagaugaacacccaauucacagcggucggcaaagaguucaaccaccuagaaaaacgcauagaaaaccuaaacaagaaaguagacgacggauuccuugacaucuggaccuacaacgccgaacuccugguacuacucgaaaacgagcgaacccuagacuaccacgacucaaacgucaaaaaccucuacgaaaaaguaagaucacaacucaaaaacaaugccaaagaaauaggcaacgggugcuucgaguucuaccacaaaugcgacaacacgugcauggaaucagucaaaaacggaaccuacgacuacccuaaauacuccgaagaagccaaacucaaccgggaagaaauagacggcgucaaacuagagagcacccgaauauaccaaauacuugcuaucuacuccaccguggcauccagccuaguccucguagucucccuaggcgccaucagcuucuggauguguuccaacggcucacuucaaugucgaauaugcaucuag

SEQ ID NO: 215682 - RNA, 1701 nt, Artificial Sequence
  derived and/or modified sequence opt from Influenza A H1N1 hemagglutinin
augaaagccauccuaguaguucuccuguacacuuucgccacugcaaacgccgacacccuaugcaucggcuaccacgcaaacaacucaacagauaccgucgauaccguccucgaaaagaaugucacagucacccacagcgucaaucuccucgaagacaaacacaacgggaaacuaugcaaacuaagaggcgucgcaccccuacaccucggcaaaugcaacaucgccggcuggauccugggcaacccagaaugugaaucacuauccacugccagcucauggucauacaucgucgaaacuccauccagcgacaacgguaccugcuaccccggcgacuucaucgacuacgaggaacuaagggaacagcuaagcaguguaagcuccuucgaacgauucgaaaucuucccaaaaacuagcucguggccaaaccacgacucaaacaaaggaguaacagccgccugcccucacgccggagccaaauccuucuacaaaaaccucaucuggcuuguaaagaaaggcaacuccuaccccaaacucuccaaauccuacaucaacgacaaaggaaaagaaguacuuguccuguggggcauccaccacccaucuacauccgcagaccagcaaucccucuaccaaaacgccgacaccuacgucuuugucggcuccucccgauacagcaagaaauuuaaaccggaaaucgccauacgaccaaaaguacgcgaccaagaagguagaaugaacuacuacuggacucucgucgaacccggagacaaaauaacuuucgaagccacugguaaccucguagucccacgauaugccuucgcaauggaacgcaacgcaggguccgggaucaucaucuccgacaccccaguccacgacugcaacacaacgugccaaacacccaaaggagcuaucaacacaucacuccccuuccagaacauucacccgaucaccaucggaaaaugccccaaauacguuaaaucaaccaaacuaagacuagccacaggacuacggaacauaccaucaauucaaucccgcggacucuucggcgccaucgccggauucauagaaggcggauggaccggaauggucgacgguugguacggcuaccaccaccaaaacgaacaaggcuccggcuacgcagccgaccucaaaagcacacaaaacgcaaucgacgaaaucacaaacaaagucaacuccguaauagagaaaaugaacacccaauucacagccgucggaaaagaguucaaccaccuagagaaaaggaucgaaaaccucaauaagaaaguugaugacggcuuccucgacauauggacuuacaacgcagaacuccucguacuacucgaaaacgaacguacccuggauuaccacgacaguaacgucaaaaaccucuacgaaaaaguacggucacaacucaaaaacaacgcaaaagaaauaggcaacggaugcuucgaguucuaccacaaaugcgacaacacaugcauggaaagcgucaaaaacgggaccuacgacuaccccaaauacuccgaagaagcaaaacuaaaccgcgaagaaaucgacggcgucaaacuagaauccacccgcauauaccaaauccuggccaucuacuccacaguagcauccagcuuaguccucguagucagccugggcgcaaucucguucuggauguguuccaacggcucccuccaaugccgcaucugcaucuaa

SEQ ID NO: 215683 - RNA, 1701 nt, Artificial Sequence
  derived and/or modified sequence opt from Influenza A H1N1 hemagglutinin
augaaagcuauccucgucguccuccucuacacguucgcaaccgcgaacgcagacacccucuguauaggcuaccacgccaacaacucaacggacaccguagacacgguccuagaaaagaacguuacagucacacacagcgucaaccugcuagaagacaaacacaacggcaaacuaugcaaacuacgcggcgucgcaccucugcaccuaggcaaaugcaacaucgcaggcuggauccuaggcaacccagaaugcgaaucccucagcacagccuccucuugguccuauauagucgaaacacccuccucagauaacggcaccuguuaccccggugauuuuaucgacuacgaggaacuccgagaacagcuaucuuccgucagcuccuucgaacgcuucgaaauauuccccaaaaccuccuccuggccaaaccacgacagcaauaaaggaguuaccgccgccugcccccacgcuggcgccaaaucauucuacaaaaaccuaaucuggcucguaaagaagggcaacagcuaccccaagcugagcaaaucauacaucaacgacaaaggcaaagaagugcucguacuguggggcauacaccaccccagcaccuccgccgaccaacaaucgcucuaccaaaaugccgacacauacgucuucgucggauccucaagauacucaaagaaauucaaacccgaaaucgcaauucgacccaaaguccgcgaucaagaaggccgcaugaacuacuacuggacacuggucgaacccggcgacaaaaucaccuucgaagccacaggcaaccucgucguaccccgcuacgcauucgcgauggaacgcaacgccggcuccggcaucaucaucagcgacacgccuguccacgacugcaacacaaccugccaaacccccaaaggcgccauaaauaccagucucccauuccagaacauccaucccauaaccaucggcaaaugcccaaaauacgugaaaucaaccaaacuccgacucgccacaggccuacgaaacauacccuccauucagucccgaggccucuucggcgcgaucgccggcuucaucgaaggcggcuggaccggcaugguagacggcugguacggcuaccaccaccaaaaugaacaagggaguggcuacgccgcagaccuaaaaagcacacaaaaugccauugacgaaaucaccaacaaaguaaacucagucaucgaaaagaugaacacccaauucaccgccgucggcaaagaguucaaccaccucgaaaaacgcauagaaaaccuaaacaagaaagucgacgacggcuuccucgacauauggaccuacaacgcggaacuccugguucuccuagaaaacgaacgaacccucgacuaccacgacucaaacgucaaaaaccuauacgaaaaaguccgcagccaacugaaaaacaacgccaaagaaaucggcaacggcugcuuugaguucuaccacaaaugcgacaacacuuguauggaaucagucaagaauggaaccuacgacuaccccaaauacucggaagaagccaaacucaaccgggaagaaaucgacggggucaaacucgaaagcaccaggaucuaccaaauccucgccaucuacagcaccguagcaagcucccucguccucgucgucagccucggcgccaucuccuucuggauguguuccaacggcucacuacaaugccgaauaugcaucuag

SEQ ID NO: 215684 - RNA, 1701 nt, Artificial Sequence
  derived and/or modified sequence opt from Influenza A H1N1 hemagglutinin
augaaagcgauccucguaguccuccuccacacauucgccacagcgaacgcagacacacuaugcaucggauaccacgcaaacaacaguaccgacaccgucgacacaguacuagaaaagaacguaaccgucacccacagcgucaaccuccucgaagacaaacacaacggcaaacuuugcaaacuccgcggagucgcaccccuacaccuuggcaaaugcaacauugcgggauggauacuaggcaacccagaaugcgaaucccuaagcaccgccagcuccugguccuacaucgucgaaacauccucauccgacaacggcacaugcuacccaggaaacuucauagacuacgaagaacucagagaacagcucuccagcguaucaaguuucgaaagauucgaaaucuuccccaaaacaucaagcuggccagaccacgacuccaacaaaggggucaccgccgccugcccccacgcgggagccaaaucauucuacaaaaaccucaucuggcuugucaagaaaggcaacagcuauccaacacucucaaaaucauacauaaacgacaaagggaaagaaguccuaguccucugggggauccaccacccauccaccuccgccgaccagcaaucccucuaccaaaacgccgacgcauacgucuucgucggcaccagccguuacuccaagaaauucaaacccgaaaucgccauccgcccaaaaguccgcaaccaagaaggacgcaugaacuacuacuggacccuaguggaacccggcgacaaaauuacauucgaagccaccggaaaccugguugccccacgauacgccuucgccauggaacgaaacgcaggcuccggcaucaucaucagugacacccccguccacgacugcaacacuacaugccaaacacccaaaggcgccaucaacaccucacugcccuuccaaaacauccacccaaucacaaucggcaaaugcccaaaauacguaaaauccacaaaacuaagacucgccaccggucucagaaacgugccguccauccaaucacgcggccucuucggagcaaucgcaggcuucaucgaaggaggauggacaggaaugguugacggcugguacggcuaccaccaucaaaacgaacagggcuccgguuacgccgccgaccucaaaagcacucaaaacgccaucgacaaaauuacaaacaaagucaacucagucauugagaaaaugaacacacaauucaccgcggucggcaaagaauuuaaccaccuugaaaaacgcaucgaaaaccuaaacaagaaaguagacgacggcuuccucgacauauggacuuacaacgcugaacuccuaguucuacucgaaaacgaacgcacacucgacuaccacgacucuaaugugaaaaaccucuacgaaaaaguacggucacaacucaaaaacaacgccaaagaaaucggcaacggcugcuucgaauuuuaccauaaaugcgacaacacaugcauggaaucagucaaaaacggcaccuacgacuaccccaaauacuccgaagaagcuaaacucaaccgcgaagaaauagacggcgucaaacuagaauccacacgaaucuaccaaauccucgccaucuacucuacaguugccuccagccucguacucguagucucccucggcgccaucucauucuggaugugcucuaacggcucccuccaaugccgcaucugcaucuaa

SEQ ID NO: 215685 - RNA, 1701 nt, Artificial Sequence
  derived and/or modified sequence opt from Influenza A H1N1 hemagglutinin
augaaagccauccuaguaguccuacuguacaccuucgccaccgccaacgccgacacccuauguaucgguuaucacgccaacaacucaacagacaccguagacacaguccucgagaaaaacgucaccgucacccacuccgucaacauacucgaagacaaacacaacggcaaacuaugcaaacuccgaggcguagcaccccugcaccuaggcaaaugcaacaucgccggauggauacucggcaaccccgagugcgaaucucuguccacggccaguuccuggucauacaucgucgaaacuucguccuccgacaacggaacaugcuaccccggcgacuucaucgacuacgaagaacuccgagaacaacuuuccuccgucagcuccuucgaacgcuucgaaaucuuccccaaaacgagcuccuggcccaaccacgacuccaacaaaggaguaaccgcagcuugcccccacgcgggcgcaaaauccuucuacaaaaaccucaucuggcuugucaagaaaggcaacucauaucccaaacucuccaaaucauacauaaacgacaaagggaaagagguccucgugcucugggguauccaccaccccucuaccuccgcagaccaacaaucccuauaccagaacgccgacgccuacgucuucgucggcagcagccgauacucaaagaaauucaaacccgagauugccauccgccccaaaguccgagaccgagaaggccgcaugaacuacuacuggacccucguggaaccgggcgacaaaauuaccuucgaagcaaccgggaaccuagucguuccccgcuacgccuucgcgauggagcggaacgccggcagcggaauaauaaucuccgacacccccguccaugacugcaacacaaccugccaaaccccaaaaggcgccauaaacaccucccuccccuuccaaaacauccacccaaucacaauaggcaaaugccccaaauacguaaaauccaccaaacucagacucgcaacuggccuacgcaacgucccaucuauccaaucccgcggccuguucggcgcaaucgccggauucaucgaaggaggguggacaggcauggucgacggaugguacggcuaccaccaccagaacgaacaaggcucaggcuacgcagccgaucuaaaauccacccaaaacgccaucgacgaaauuacgaacaaagucaacuccgucauagaaaagaugaacacccaauucaccgccgucggcaaagaguucaaccaccuggagaaaagaaucgaaaaccucaacaagaaagucgacgacggcuuccuagauauauggaccuacaacgccgaacuccuaguccuucucgaaaacgaacgcacacucgacuaccacgacucaaacgucaaaaaccucuacgaaaaaguacguucacaacuuaaaaacaacgccaaagaaauaggcaacggcugcuuugaguucuaccacaaaugcgacaauaccugcauggaauccgucaaaaacggaacauacgacuacccgaaauacuccgaagaagcaaaacuaaacagagaagaaaucgacggcguaaaacuagaaagcacacgaaucuaccaaauccucgcaaucuacuccaccgucgccuccucccuaguccuaguagugucccucggcgccaucuccuucuggaugugcuccaacggcucccuccaaugccgcauaugcauauaa

SEQ ID NO: 215686 - RNA, 1701 nt, Artificial Sequence
  derived and/or modified sequence opt from Influenza A H1N1 hemagglutinin
augaaagccauccuagucguccuccucuacaccuucgccacagcaaacgccgacacgcucugcaucggauaccacgccaacaacuccaccgacaccguagacacuguacucgagaaaaaugucaccguaacccacagcgucaacauacucgaagacaaacacaacggaaaacucugcaaacuacgcggcguagccccgcuccaccucggcaaauguaacaucgccggauggauccucggcaaccccgaaugcgaaucccucuccaccgcaucaucgugguccuacaucguagaaaccuccuccagcgacaacgggacaugcuaccccggggacuucauagacuacgaagaacucagagaacaacucagcagcgucagcagcuucgaacguuucgaaaucuucccaaaaaccagcucauggccgaaccacgacucaaacaaaggcguaaccgccgcaugcccacacgcaggcgccaaaucauucuacaaaaaccuaauauggcucguuaagaaaggaaacuccuaccccaaacugucaaaaagcuacaucaacgacaaaggcaaagaaguccuaguacucuggggaauccaccacccaagcaccuccgccgaccaacaaucacuauaccaaaacgccgacgcauacgucuucgucggaucgucccgcuacucaaagaaauucaaaccugaaaucgccauccgacccaaaguccgcgaucaggaaggccgaaugaacuacuacuggacccuggucgagccaggagauaagaucacauucgaagcaaccggcaaccucgucgucccccgguacgcauucgcaauggaaagaaacgccggcagcggcaucaucaucucagacacaccugugcacgacugcaacacaacaugccaaacgccaaagggcgccaucaacacaucgcuaccauuccaaaacauacaccccauuaccaucggcaagugcccuaaauacgugaaauccaccaaacuucgccucgccacaggccuacgcaacguccccagcauccaaucacgcggccuauuuggcgccaucgcaggcuucaucgaaggaggcuggaccggaauggucgacggcugguacggauaccaccaccaaaacgaacaaggcaguggcuacgcagccgaccucaagagcacacaaaacgcaauagacgaaaucaccaacaaaguaaacagcguaauagagaaaaugaacacucaauucaccgccguaggcaaagaguucaaccaccuagaaaaacgcaucgaaaaccucaacaagaaaguagacgacggauuccuagacauauggaccuacaacgcagaacugcuagugcuacucgaaaaugaaagaacccucgacuaccacgacucaaacgucaaaaaccuguacgaaaaaguccgcucacaacucaaaaacaacgccaaagaaauuggcaacggcugcuucgaguucuaccacaaaugugacaacacaugcauggaaucagucaaaaacggcacauaugacuauccaaaauacucagaagaagccaaacugaacagagaagaaauagacggcgucaaauuagaaagcacuaggauauaccagauacucgccaucuacuccaccgucgccucuucccuaguccucgucguaagccuaggcgccaucagcuucuggauguguagcaacggcucacuccaaugccgcauaugcaucuaa

SEQ ID NO: 215687 - RNA, 1701 nt, Artificial Sequence
  derived and/or modified sequence opt from Influenza A H1N1 hemagglutinin
augaaagcuauccucgucguacuacucuauaccuucgcaaccgccaacgcggacacccuaugcaucggcuaccacgcaaacaacagcaccgacaccgucgacaccguacucgagaaaaacgucaccgugacacacucagucaacauccuggaagacaaacacaacggcaaacucugcaaacuacgagggguagcuccccuucaccuaggaaaaugcaacauagccggguggauucucggcaaccccgagugcgaaagccuaagcacagccuccuccuggucauacaucgucgaaacauccuccucagacaacgguaccugcuaccccggcgacuuuaucgauuacgaagaacucagagaacaacucucaucggucagcucauucgaacgcuucgaaaucuucccaaaaacaucaucauggcccaaccacgacuccaacaaaggcgucacagccuccugcccccacgccggcgccaaauccuucuacaaaaaccuaaucuggcuaguaaagaaagguaacuccuaccccaaacugagcaaaagcuacauuaacgacaaaggcaaagaaguccuaguacucuggggcauccaccacccauccaccuccgcagaccaacaaagccuauaccaaaacgcagacgcauacgucuucguaggaagcucccgcuacagcaagaaauucaaaccagaaaucgccauucgccccaaaguccgcggccaggaaggccgcaugaacuacuacuggacccucgucgaaccaggcgacaaaaucaccuucgaagcgaccggaaaccuuguagucccacgcuacgcauuugccauggaacgcaacgccggaagcggaauaaucaucagcgacaccccaguccacgacugcaacacaaccugccaaacccccaaaggagccaucaacaccucccuccccuuccaaaacauccaccccaucacaauagguaaaugccccaaauacgucaaaagcaccaaacuacgccuagcaaccggccuccgcaacgucccaagcauccaaagucgcggacucuuuggcgccaucgccggauucauagaaggcggauggacaggcaugguagacggcugguacggcuaccaccaccagaacgaacaaggaagcggauacgccgcggaccucaaaagcacccagaacgcaaucgacgaaauaaccaacaaaguaaacucagucaucgagaaaaugaacacgcaauucaccgcugucggcaaagaguucaaccacuuagagaaaaggaucgaaaaccuaaacaagaaaguagacgacggcuuccuagacaucuggacauacaacgccgaacuccuaguucuccucgaaaacgaacgaacgcucgacuaccacgauagcaacguuaaaaaccuuuacgaaaaaguccgaucccaacucaaaaacaacgcaaaagaaauaggcaacggcugcuucgaguucuaccacaaaugcgacaacacaugcauggaauccgucaaaaacgggaccuacgacuacccaaaauacucagaagaggcaaaacuaaaccgcgaggaaauagacggagucaaacuagaaagcacaagaauauaccaaauccuagccaucuacagcaccgucgcaucaucacucguacucgucguuucccucggagcuaucagcuucuggaugugcuccaacggaucacuacaaugccgcaucugcaucuaa

SEQ ID NO: 215688 - RNA, 1701 nt, Artificial Sequence
  derived and/or modified sequence opt from Influenza A H1N1 hemagglutinin
augaaagcaauccuagucguacuauuguacacguucacuacagcaaacgccgacacacucugcaucggcuaccacgccaacaacuccacagacaccguagacaccguccuagagaaaaacgucaccgucacccauucagucaaucuacuagaaaaccgucauaacggcaaacuaugcaaacuucgcggagucgcaccacuccaccucggcaagugcaacaucgccggcuggcuccuaggcaacccagaaugcgaaucccucuccaccgccuccagcuggagcuacauaguagaaacauccaacagcgacaacggaaccugcuacccaggcgacuucaucaacuacgaagaacuuagagaacaacuaaguagcguaucaucguucgaacgcuucgaaauauuccccaaaaccucuagcuggccaaaccaugacacaaaccgcggcguaacagcagccugcccccacgccggcaccaacagcuucuaccgcaacuuaauauggcuagucaagaaaggaaacagcuacccaaaaauaaacaaauccuacauaaacaacaaagaaaaagaaguccucgucuugugggcaauccaccacccaagcacauccgccgaccaacaaucccucuaccaaaacgccgacgcauaugucuucgucggcagcucacgcuauucccgaaaauucgaacccgaaauagcuacacgacccaaaguacgcgaccaagccggccgaaugaacuacuacuggacucuagucgaaccaggagacaaaauaacauucgaagccacaggaaaccucgucgucccccgcuacgcauucgcccucaaacgaaacuccggaucaggaaucauaaucucggacaccucaguccacgacugcgacacuacaugccaaacacccaacggugcaauaaacacaucccuccccuuccaaaacauccacccagucaccauaggcgaaugccccaaauacguaaaaagcacuaaacuccgaauggccacaggccugcgcaacauccccagcauacaaucacgcggccuauucggagccauagcuggcuucaucgaaggcggcuggaccggaaugaucgacggcugguacggcuaccaccaccaaaaugagcaaggcagcggcuacgccgccgaccucaaaagcacccaaaacgccaucgacggcaucacgaauaaggucaacagcgucaucgagaaaaugaacacacaauucacggcagugggaaaagaguucagccaccucgaacgccgcauagaaaaccucaacaagaaagucgacgacggcuuccucgacauauggaccuacaacgccgaacuccuaguccuccucgaaaacgaacgcacccucgauuaccacgacucaaacgucaaaaaccucuacgaaaaagucagaagccaacucaaaaacaacgccaaagaaaucggcaacggcugcuucgaauuuuaccacaaaugcgacgauaccugcauggagucagucaaaaacggcaccuacgacuaccccaaguacucagaagaagccaaacuaaaccgagaggaaaucgacggaguaaagcucgaaucaaccagaaucuaccagauccucgccauauacuccaccgucgcauccucccucguccucgucgugagucuaggugcaaucucauucuggaugugcagcaacggcucacuccaaugccgaauaugcaucuaa

SEQ ID NO: 215689 - RNA, 1701 nt, Artificial Sequence
  derived and/or modified sequence opt from Influenza A H1N1 hemagglutinin
augaaagccauacucgucguacuccucuacaccuucacaaccgcgaacgccgacacacucugcaucggauaccacgccaacaacucaaccgacaccgucgacaccguccuagaaaagaacgucacagucacccauagcgucaaccuccucgaaaaccgccauaacggaaaacucugcaaacuacgcggggucgcaccccugcaccuaggcaaaugcaacaucgccggguggcuccuaggcaaccccgagugcgaauccuuaagcaccgccucauccugguccuacaucgucgaaacaagcaacuccgacaacggcacaugcuaccccggcgacuucaucaacuacgaagaacuccgggaacaacucucauccguaagcucguucgaacgcuucgaaauauuccccaaaaccuccucguggccaaaccacgacaccaaccgaggcgucaccgcggccugcccccacgccggcaccaacagcuucuaccgaaaccuaaucuggcuggucaagaaaggaaacuccuaccccaaaaucaacaaaagcuacaucaacaacaaagagaaagaaguccuaguccuaugggcgauccaccaccccagcaccuccgccgaccaacaaucaaucuaccaaaacgccgacgcauacgucuucguaggcuccucccguuacuccagaaaauucgaacccgaaaucgccacccguccaaaaguccgagaccaagcaggccgcaugaacuacuacuggacccucguagagcccggcgacaaaauaaccuucgaagccaccggcaaucuggucgucccacgauacgccuucgcccuuaaacgcaauuccggauccgggauaaucauaucggauacuagcguccacgacugcgacacaaccugccagacccccaacggagccauaaacaccucccuacccuuccaaaacauccacccaguaaccaucggcgaaugcccuaaauacguuaaaagcaccaaacucagaauggccacaggccuccgaaacauacccucaauccaaucccgcggacucuucggagccaucgcaggauucauagaaggaggcuggaccggcaugaucgacgggugguauggcuaccaccaccaaaacgaacaaggcuccggauacgcugccgaccuaaaauccacacagaacgcuaucgauggcauaacuaauaaaguaaacuccgucaucgagaaaaugaacacccaauucaccgccguaggaaaagaguucucucaccucgaacgucggaucgaaaaccucaacaagaaagucgacgacggauuccuagacauauggacauacaacgcagaacuccucguucuccucgaaaaugaacgcacccucgacuaccacgacucuaacgucaaaaaccucuacgaaaaagucagaucccaacugaaaaacaacgccaaagaaauaggcaacggaugcuucgaguucuaccacaaaugcgacgacacaugcauggaauccgucaaaaacggaaccuacgacuaccccaaauacuccgaagaagccaaacuaaaccgcgaagaaaucgacggagucaaacuagaauccacacgaauauaccaaauccuagcaaucuacuccacugucgccucaucccuaguccucgucguuucauuaggcgcaaucagcuucuggauguguuccaacggaucccuacaaugccgcauaugcauauaa

SEQ ID NO: 215690 - RNA, 1701 nt, Artificial Sequence
  derived and/or modified sequence opt from Influenza A H1N1 hemagglutinin
augaaagcaaucaucgucguccuacucuacacguucgcaaccgcggacgcagacacccucugcauaggcuaccacgcaaacaacucaacagacacaguugacaccguacucgaaaagaacgucacggucacccacuccguaaaccugcucgaaaacaaacacgacggcaaacucugcaagcuccgcggcguagccccacuacaccucggcaagugcaacaucgccggauggcuacugggcaaccccgaaugcgaaagccucuucacggccucgagcugguccuacaucgucgaaaccccaaacuccgacaacggaaccugcuaccccggcgacuucaucaacuacgaagaacuaagggaacaccucucauccgucagcuccuucgaacgcuucgaaaucuuccccaaagcaaacuccuggccaaaccacgacacgaacaagggcgucaccgccgccugccccuacgccggcgcaaacuccuucuacagaaaccucauauggcucgucaagaaaggcaacuccuaccccaaacuauccaaauccuacaucaacaacaaaaagaaagaaguccucgucauaugggguauccaccauccaccaacaaguaccgaccaacaaacucuauaucaaaacgcggacgccuacguauucgucggaagcucgaaauacuccaaacgcuucaaacccgaaaucgcagcccgaccaaaaguacgcaaccaagccggucgcaugaacuacuacuggacccucauugaaccaggcgacacaauaacauucgaagccaccggaaaccucguuguacccagguacgcauucgcaaugaaaagaggcagcgguucaggaauaaucgucuccgacgcaccaguccacgacugcaacaccacgugccaaacaccgaaaggugcaauaaacacaagccuucccuuccaaaacauccaccccguaacaaucggcgaaugcccaaaauacgucaaauccacaaaacuacgcauggccacaggccuccgcaacaucccguccauacaaucccgaggacuauucggcgcgaucgccggcuuccucgaaggcggcuggaccggcaugaucgacggaugguacggcuaccaccaccagaaugaacaaggcagcggcuacgcagccgaccaaaaaucgacccaaaacgccaucgacggcauuaccaacaaggucaacagcauaauagaaaagaugaacacacaauuuaccgccgucggcaaagaguucaaccaacucgaaaagaggaucgaaucgcugaacaacaaagucgacgacggcuuccucgacauauggaccuacaaugcagaaauguuggugcuccuugaaaacgaacgcacacucgacuaccacgacucgaacgucaaaaaccuauacgaaaaaguccgaucccagcucaaaaacaacgcaaaagaaaucggcaacggcugcuucgaguucuaccacaaaugcgacaauaccugcauggaaucagucaaaaacggaaccuacgacuacccaaaauacucagaagaagccaaacucaaccgcgaagaaauagacgguguaaaacucgaauccgcacgcaucuaccagauccuagcuaucuacucuaccguagccagcagccuaguccuccuaguuagccucggagccgucuccuucuggaugugcuccaacggaucucuacagugccggaucugcaucuag

SEQ ID NO: 215691 - RNA, 1701 nt, Artificial Sequence
  derived and/or modified sequence opt from Influenza A H1N1 hemagglutinin
augaaagccaucauagucguccuacucuacaccuucgcaacagcagacgccgacacccuaugcaucggcuaccacgcgaacaauuccacagacaccguagacaccguccuagagaaaaacguaaccgucacacacuccgucaaccuacucgaaaacaagcacgacggcaaacucugcaaacuaagaggcguagccccacuucaccuaggaaaaugcaauaucgcaggauggcuguuaggcaaccccgaaugcgaaucccuauucaccgccucauccuggagcuacauagucgaaacacccaacuccgacaacggaaccugcuacccaggcgacuucaucaacuacgaagaacuccgcgaacaccucucaagcguaagcuccuucgaacgcuucgaaauauuccccaaagcaaacuccuggcccaaccacgaaacaaacaaaggcgucacagcagccugccccuacgccggcgccaacucuuucuaucgaaaccucaucuggcuugucaagaaaggcaacuccuaccccaaacucuccaaaagcuacaucaacaacaaaaagaaagaaguacucgucauauggggaauccaccacccacccacguccaccgaccaacaaacacucuaucaaaacgccgacgccuaugucuucguaggauccuccaaauacagcaagagauucaaacccgaaauagcagcccggcccaaagugcgaaaccaagccggccgcaugaacuacuacuggacccuaaucgaacccggcgacacuauuacauucgaagccacaggaaaccucgucgucccccgauacgcauucgcaaugaaacgcggcaguggcuccggcaucauuguuucagacgccccaguccacgauugcaacacaaccugccaaacccccaaaggcgccauaaacaccagccuacccuuccaaaacauacacccaguuacaaucggcgaaugcccuaaauacgucaaguccacuaaacuaagaauggccaccggccuccgcaacauccccuccauccaaagccgcggccucuuuggagcgaucgccggauuccuagagggaggauggaccggcaugaucgacggcugguacggauaccaucaccaaaacgagcaaggcagcggauaugccgccgaccaaaaauccacccaaaacgccauagacggcaucaccaacaaagucaacucaaucauagagaaaaugaacacccaguuuaccgcggucggcaaagaguucaaccaacuagaaaaacgcaucgaaucccucaacaacaaaguagacgacggcuuccucgacaucuggacauacaacgccgaaaugcuaguccuccucgaaaacgaacgcacgcucgacuaccacgacagcaacguuaaaaaccucuacgaaaaagucagaucacagcucaaaaacaacgcuaaagaaaucggcaacggaugcuucgaguucuaccacaaaugcgacaacaccuguauggaaagcguaaagaacggaaccuacgacuaccccaaauacucagaagaagcaaaacuaaaccgcgaagaaauagacggcgucaaacuagaaucagcacgcaucuaccagauccucgccauauacuccacagucgccuccucccucguccuccuaguaucacucggagcagucucauucuggaugugcucaaacggcagccuccaaugucgaauaugcaucuaa

SEQ ID NO: 215692 - RNA, 1701 nt, Artificial Sequence
  derived and/or modified sequence opt from Influenza A H1N1 hemagglutinin
augaaagccauccuagucguacuucuuuacaccuucacaacagcuaacgccgacacacuaugcauaggcuaccacgcaaacaacuccacagacaccgucgauaccguucuagagaaaaacgucaccguaacccacucaguaaaccuccucgaaaaccgccauaacggcaaacuaugcaaacuccgcggaguagcaccccuccaccucggcaaaugcaacaucgccgguuggcuacuuggcaaccccgaaugcgaaucacucuccacagccagcucuugguccuacaucgucgaaacaucaaacuccgacaacggaaccugcuacccaggcgacuucauuaacuacgaggaacuccgagaacaacucucaucagucuccuccuucgaacguuucgagaucuucccaaaaaccuccagcuggccuaaccacgacacuaaccguggcgucaccgccgccugcccccacgccggcacaaacuccuucuauagaaaccucaucugguuaguaaagaaaggcaacuccuacccaaaaaucaauaaauccuauaucaacaacaaagaaaaggaaguccucgugcucugggccauccaccaucccuccacauccgccgaccaacaaucccucuaccaaaacgcggacgcauacguauucgucgggagcucccgcuacucccgcaaauucgaaccagaaaucgcaacccgcccuaaaguacgcgaccaagcaggccgcaugaauuacuacuggacccucgucgaaccaggagacaaaauuacauucgaagccacgggcaaccucgucguaccccgcuacgcauucgcccuuaaacgaacguccggaucgggcauaaucaucuccgacaccagcguccacgacugcgacacgacaugccaaacaccgaauggggcaauaaacaccagccuacccuuccaaaauauccacccggucaccaucggagaaugcccuaaauacgucaagucaaccaagcugcggauggccacaggccuccgaaacauuccaagcauccaaucccgcggacucuucggagccaucgccggcuuuauagaaggcggauggaccggcaugauagacggcugguacggcuaccaccaccaaaaugaacaaggcagcggcuacgccgccgaccucaaaucaacccagaacgccaucgauggaaucaccaacaaaguaaacuccguaaucgaaaagaugaacacccaauucaccgccgucggaaaagaguucucacaucuagaacgccgaaucgaaaacuuaaacaagaaagucgacgacggauuccucgacauauggacauauaacgccgaacuacuuguacuacuagaaaacgaacgaacacucgacuaccacgacuccaacguaaagaaccuuuacgaaaaaguaagaucacaacuuaaaaacaacgccaaagagaucggaaacgggugcuucgaauuuuaucacaaaugcgaugacaccuguauggaaagcgucaaaaacggcaccuacgacuacccuaaauacucagaagaagcaaaacuaaaccgcgaagaaauagacggcguaaaacucgaauccacgcgcaucuaccagauccucgccauauacagcacuguagccagcagccuaguccucgucgucucccucggcgcaaucuccuucuggaugugcucaaacggaucccuccaaugccgaaucugcaucuaa

SEQ ID NO: 215693 - RNA, 1701 nt, Artificial Sequence
  derived and/or modified sequence opt from Influenza A H1N1 hemagglutinin
augaaagcuauacuggucguacucuuauacaccuucacaaccgccaacgcagacacccucugcauaggcuaccacgccaacaacuccacagacaccgucgacacaguccuugaaaagaacgugacagucacccacuccgugaaccuucucgaaaaccgccacaacggaaaacuaugcaagcuccgcggcguagcaccccuucaccugggcaaaugcaacaucgcaggcuggcuccucgguaaccccgaaugcgaauccuuguccaccgccucaagcuggucauacauagucgaaaccuccaacucagacaacggaaccugcuaccccggcgacuucaucaacuacgaggaacuacgugaacagcucucaucaguauccagcuucgaacgcuucgaaaucuucccgaaaaccucaucauggccgaaccacgaaaccaaccgcggcgugaccgcagcgugcccccaugccggcacaaacuccuucuaccgcaaccuuaucuggcucgucaagaaaggcaacagcuaccccaaaaucaacaaauccuacaucaacaacaaagaaaaagagguccuaguacucugggccauccaccacccaagcaccucagcagaccaacaaucacuauaccaaaacgcagacgccuacgucuucgucggauccucccgcuacagccgaaaauucgagccagaaauagccacccgcccaaaagucagagaccaggcaggccggaugaacuacuacuggacccucgucgaaccuggcgacaaaauaacuuucgaagccaccggcaaccucgucgugcccagauacgccuucgcacucaaacgcaccucagggagcgggaucauaaucuccgacaccagcguccacgacugcgacacuaccugccaaacccccaacggagccaucaacaccagccuaccguuucaaaacauacaucccguaaccaucggcgagugcccaaaauacguuaaguccaccaaacuacgaauggccaccggccugcgcaacaucccauccauccaaucccgcgggcucuuuggagccaucgcaggcuucaucgagggaggauggacaggcaugaucgacgggugguacggcuaccaccaccaaaacgaacaaggcagcgguuacgccgcagaucuaaagagcacacaaaacgcaaucgacggaauaacuaacaaagucaacagcgucaucgagaaaaugaauacccaauuuacagcagucggcaaagaguucucccaccucgaacgccgaaucgaaaaccuaaauaagaaaguagacgacggcuuccucgacaucuggacauacaacgcagaacugcucguucuccucgaaaaugaaagaacccucgacuaccacgacucaaacgucaaaaaccucuacgaaaaaguaagaagccagcucaaaaacaacgccaaagaaaucggcaacggcugcuucgaguucuaccacaaaugcgacgacacuugcauggaauccgucaaaaacggaaccuacgacuacccgaaauacucagaagaagccaaacucaaccgcgaagaaaucgacggaguaaaacucgaauccacacgcauauaccaaauacuggccauauacucaacaguggccagcucccucguccuaguaguaucacugggggcuaucuccuucuggaugugcuccaacggcucccuccaaugccgcaucugcaucuaa

SEQ ID NO: 215694 - RNA, 1701 nt, Artificial Sequence
  derived and/or modified sequence opt from Influenza A H1N1 hemagglutinin
augaaagcaaucaucguuguacuacuuuacaccuucgccaccgcagacgccgacacgcuaugcauaggcuaccacgccaacaacuccaccgacaccguagacacaguccuugaaaagaacgucaccguaacccacagcgugaaccuucucgaaaacaagcacgacggcaaacucuguaaacugcgcggcgucgcuccccuucaccucggaaaaugcaacaucgcaggcuggcuacucgguaacccagaaugugaaucccuauucgcagccucgagcuggagcuauauaguggaaacaccaaacucagacaacggaaccugcuacccaggcgacuucauaaacuacgaagaacuacgcgaacaccucuccagcgucuccucguucgaacguuuugaaaucuucccaaaagccaacucguggcccaaccacgacacaaacaaaggcgucaccgcagccugccccuaugccggugcaaauuccuucuacagaaaccuaaucuggcucgucaagaaaggaaauuccuacccaaaacucucgaaaucauacaucaacaauaaaaagaaagaaguccucgucaucuggggaauccaccacccacccacaagcacagaccagcaaacccucuaccaaaacgccgaugccuacguauucgucggcuccuccaaauacuccaaaagauucaaacccgagauagccgcccgccccaaagugcgugaccaagcgggcaggauggacuacuacuggacacucauagaacccggcgacacaauaacauucgaagcuacaggcaaccucguaguuccccgauacgccuucgccaugaaacgcgggagcggcagcggaaucauagucuccgacgccccaguccacgacugcaacacaaccugccaaacccccaaaggagccaucaacaccagccuacccuuccaaaacauccaccccgugaccaucggcgagugcccaaaauacgucaaauccaccaaacuacgaauggccacgggccuacgcaacauccccagcauacaaucacgcggccucuucggcgccaucgccggauucaucgaaggcggcuggaccggcaugaucgacggcugguacggcuaccaccaccaaaaugaacaaggcagcggcuacgcggcugaccagaaauccacacaaaacgcaauagacggaaucacaaacaaaguaaacagcauaaucgaaaagaugaacacacaauucaccgccguaggaaaagaguucucacaacucgaaaagcgcaucgaaucccucaacaacaaagucgaugacggcuuccucgacaucuggaccuacaacgcagaacugcucguacuacucgaaaacgaacgcacccuagacuaccaugacucaaacgucaaaaaccucuaugaaaaaguccgcucccagcucaaaaacaacgcaaaagaaaucggcaacgguuguuucgaguucuaucacaaaugcgacaauaccugcauggaaucagucaaaaacggcaccuaugacuacccaaaguauuccgaagaagcaaagcucaaccgcgaagaaaucgacggagucaaacuagaaucagcacgaauauaccagauacuagccaucuacucaaccgucgcauccagccucguccuccuuguaucccugggcgccgucucauucuggaugugcuccaacggcucgcuccaaugcagaauaugcaucuaa

SEQ ID NO: 215695 - RNA, 1701 nt, Artificial Sequence
  derived and/or modified sequence opt from Influenza A H1N1 hemagglutinin
augaaagccauccucgucguacuacuguacacauucaccaccgccaacgcggacacgcuaugcauaggcuaccacgccaauaacuccaccgacaccguggacacuguccuggagaaaaaugucacugucacccacuccgugaacuuacuugaaaaccgacacaacggcaaacucuguaaacuacgcggagucgcaccccuacaccuaggcaaaugcaacaucgcgggcuggauccuaggcaaucccgaaugugaaagccucucgacggccucgagcuggaguuacaucguagaaaccuccaacagcgaaaacggcacuugcuaccccggcgacuucaucaacuacgaagaacuccgcgaacaacuaucaagcgucuccucguucgaacgauucgaaaucuucccaaaaaccagcuccuggccaaaccacgacacaaacaaaggcguaacugccgccugcccccacaguggcaccaacuccuuuuauagaaaccucgucuggcucguccaaaaaggcaacagcuaccccaaaaucaacaaaucauacauaaacaacaaagaaaaugaaguccugguccucugggccauacaccaccccucaaccagcgccgaccagcaaucgcucuacaaaaacgcagacgccuacgucuucguaggaagcucccgcuacuccagaaaauucgagccagaaaucgccacacgcccgaaaguacgcgaccaagccggacgcaugaacuacuacuggacccucgucgaaccaggagacaaaaucaccuucgaagcuacaggaaaccuaguagcgccacgauacgcauucacccucaaacgcaacagcggcagcggcaucaucaucuccgacacaaguguccacgacugcgacacaacgugccagacacccaacggagcaauaaacacuagccucccauuccagaacauccaucccgucaccauaggcgagugcccuaaauacguaaaaaguacuaaacuacgaauggccacaggccuccgcaauauccccagcauacagucacgcggacucuucggcgcaaucgcaggcuucauagaaggcggguggaccggcaugauagacggcugguacggauaccaccaccaaaacgaacaaggauccggcuacgcagcagaccucaaaagcacgcaaaacgccaucgacgggaucacuaacaaagucaacucagucaucgagaaaaugaacacccaauucaccgcggucggaaaggaguucucccaccucgaaagacguaucgaaaaucucaacaagaaagucgacgacggguuccuagacauauggacauacaacgccgaacuccuaguccuacucgagaacgaaagaacccuagacuaccaugacucaaacgugaaaaaccucuacgaaaaaguccgaagccagcucaaaaacaacgcgaaagaaaucggcaacggcugcuucgaguucuaccacaaaugcgacgacaugugcauggaauccgucaagaacggcacauacgacuaccccaaauacucagaagaagccaaacuaaaucgagaagaaaucgacggcgucaaacucgaauccaccaaaauauaccaaaucuuggccauauauuccaccgucgccucaucccuaguccuaguaguaucccuaggcgcgaucuccuucuggaugugcagcaacggcucacuccaaugccggaucuguaucuaa

SEQ ID NO: 215696 - RNA, 1701 nt, Artificial Sequence
  derived and/or modified sequence opt from Influenza A H1N1 hemagglutinin
augaaagccaucaucguuguacuccucuacacauucgccaccgccgacgcagacacacucugcauaggauaccacgccaacaacucaacagacaccgucgacaccguccucgaaaagaacguuacggugacacacucaguaaaccugcucgaaaacaaacacgacggaaagcugugcaaacugcguggaauagcaccccuccaccucggcaagugcaacaucgccggguggauccugggcaaccccgaaugcgaaagccucuucacgaccucgagcugguccuacaucguggaaacgccaaacagcgacaacggaaccugcuaccccggagacuucauaaacuacgaagaacuccgcgaacaccuauccagcgucagcuccuucgaacgcuucgaaaucuuccccaaagcaaacuccuggcccuaccacgacaccaacaaaggcgugaccgcagccugcccauacgccggagccaacagcuucuacagaaaccucaucuggcucgucaaaaagggcaauuccuacccaaagcucucaaaaucguacaucaacaacaagaagaaagaagucuuagucaucuggggcauacaucacccgcccaccuccaccgaccaacaaacgcuuuaccaaaacgcggacgccuacguauucgucggcuccuccaaauacuccaaacgcuucaaacccgaaaucgccgcgcgccccaaaguaagagaccaagcaggccgcauggacuacuauuggacacucaucgaacccggcgacaccaucaccuucgaagccaccggcaaccuaguagucccaagauacgccuucaccaugaagcgcgguuccggaagcggcaucaucgucucugacgcgccagugcacgacugcaacacuaccugccaaaccccgaaaggcgccaucaacaccucccugccuuuccaaaacauacaucccgucaccaucggagaaugcccgaaauacguaaaaagcaccaaacuccguauggcuaccggccuacgcaacauccccuccauccaaucccgaggccuauucggcgccauagcagguuucaucgaaggcggguggaccggcaugauagacggcugguauggcuaucaccaccaaaacgaacagggaucaggcuacgccgccgaccaaaaguccacgcaaaacgccauagacggcaucaccaacaaggugaacuccauaauagagaaaaugaacacgcaauucacagcagucggaaaagaguucucccaacuagaaaaacgcaucgaaucacuaaauaacaaaguagacgacggguuucucgacauauggaccuacaacgccgaacuucugguccuccuagaaaacgagcgcacgcucgacuaccacgacucaaacgucaaaaaccucuacgaaaaagucagaagccaacucaaaaacaacgccaaagaaaucggcaauggaugcuuugaguucuaccauaaaugcgacgauaccugcauggaaucggucaaaaacggaaccuacgacuacccuaaauacucggaagaagccaaacuaaaccgacaagaaaucgacggggucaaacuagaaucagcccguauauaccaaauccuagccauauacuccaccgucgccuccagccuaguccugcucguaucauugggagccguaucauucuggaugugcaguaacggcucacuccaaugcaggaucugcauauaa

SEQ ID NO: 215697 - RNA, 1701 nt, Artificial Sequence
  derived and/or modified sequence opt from Influenza A H1N1 hemagglutinin
augaaagccauacucguaguccuucucuacaccuucaccacugccaacgcagacacccucugcauaggcuaccacgccaacaacucaacagacaccgucgacaccguccuagagaaaaacgucaccguaacacacagcguaaaccuacucgaagacaagcacaacggcaagcucugcaagcucggaggcguagcaccccuccaccucggcaaaugcaacaucgcggguuggauccuaggcaaccccgaaugcgaaucccucuccaccgcauccagcuggagcuacaucgucgaaaccagcaacucagacaacggaaccugcuaucccggcgacuucauaaacuacgaagaacuacgcgaacaacucucuuccgucagcuccuucgaacgcuucgaaaucuucccaaaaacgaguuccuggccaaaccacgacuccaacaaaggaguaacagccgccugcccccacgccggcgcaaaaucauucuacaaaaaucucaucuggcucgucaaaaagggcaacagcuaccccaaacucaaccaauccuacaucaacgacaaaggcaaagaaguacucguccucuggggcauacaccaccccaguacaacagccgaccagcagucccucuaccaaaacgcugacgccuacgucuucgucggcaccucccgcuacucaaagaaauucaaacccgaaaucgccacacgcccaaaaguacgagaucaagaaggcagaaugaauuacuacuggacacucguagaaccaggcgacaaaauaacauucgaagcaaccggaaaccuaguagugccccgcuacgcauucaccauggaacgaaacgccggaucaggcauaaucaucuccgauacccccguccacgacugcaacacuaccugccaaaccccagaaggugcaauaaacaccucccuccccuuccaaaacauccacccaaucaccauaggcaaaugccccaaauacguaaaauccacaaagcuacgucucgcgaccggacuccgcaacguaccuuccauccaaucccgcggccucuucggcgcaaucgccggcuucauagaaggcggauggacagguaugguagacggcugguacgguuaccaccaccaaaacgaacaaggauccggcuacgccgccgaccuaaaauccacccagaacgcaaucgacaaaaucacaaacaaagucaacagcgucauagaaaagaugaacacacaauucaccgcaguaggcaaagaauuuaaccaccucgagaaaagaaucgaaaaccucaacaagaaagucgacgacggauuccucgacaucuggaccuacaacgcagaacugcuagugcuacucgaaaacgaaagaacccuagacuaccacgacuccaaugucaaaaaccuuuacgaaaaaguccgaaaccaacucaaaaacaacgccaaagaaauuggaaacggcugcuucgaguucuaccacaagugugacaauaccugcauggaauccgucaaaaacggaaccuacgacuaccccaaauacuccgaagaagccaaacuaaaccgcgagaaaauugacggcguuaaacucgaauccacacgcaucuaccaaauacucgccauuuacaguacuguagccucgagccuaguccugguagucucacuaggagccaucagcuucuggaugugcuccaacggcucccuccagugccggauaugcaucuaa

SEQ ID NO: 215698 - RNA, 1701 nt, Artificial Sequence
  derived and/or modified sequence opt from Influenza A H1N1 hemagglutinin
augaaagccauacucgucguccugcucuauaccuucaccacagccaacgccgacacccucugcauaggcuaccacgcaaacaacucaaccgauaccguugacacuguccucgaaaaaaacguaaccgucacccacuccgucaaccuccuagaggacaaacacaauggaaaacucuguaaauuaggcggcguggccccccuacaccuuggaaaaugcaacaucgccggguggauacucggcaaccccgagugcgagucacucuccaccgccuccucaugguccuacauagucgaaacaagcaacuccgacaacggaaccuguuacccaggcgacuucauaaacuacgaagaacuacgugaacaacuaucaucagucagcuccuucgaacguuucgaaaucuucccuaaaaccuccagcuggcccaaccacgacuccaacaaaggagucacagccgccugcccccacgccggagccaaauccuucuacaaaaacuuaaucuggcucgucaagaaaggcaacucauacccaaaacucaaucaauccuacauaaacgacaaaggaaaagaagugcucguucuguggggcauccaccaccccuccaccacagccgaccaacagagcaucuaccaaaacgcagacgcauacguuuucgugggaaccuccagauacucaaaaaaauucaaacccgagaucgcaacccgccccaaaguccgagaccaggaaggacgcaucaacuacuacuggacccuaguagaaccaggagacaaaaucaccuucgaagcaaccggcaaccuagucguaccacgauacgccuucacaauggaacgaaacgccggaagcggaaucaucauaucgaacacccccgugcacgacugcaacacaaccugccaaacccccgaaggcgccaucaacaccucucuccccuuccaaaauauccaccccaucacuaucggaaaaugcccaaaauacgucaaaagcaccaaacuccgacuagcaaccggccuccgaaacguccccuccauccaaagccgaggccucuucggagccaucgccggcuucaucgagggcggcuggaccggcauggucgacggcugguacggcuaccaccaccaaaacgaacaaggcuccggcuacgcagcagaccuaaaauccacccaaaacgcuauagacaagaucacaaacaaagucaauucaguaaucgaaaaaaugaacacccaauucaccgccguaggaaaagaauuuaaccaucucgaaaaacggaucgaaaaccucaacaaaaaagucgacgacggcuuucuagacauauggaccuacaacgccgaacugcuaguccuccuagaaaacgaacgcacccucgacuaccacgacagcaacguaaaaaaccucuacgaaaaaguccgaaaccaacugaaaaacaacgccaaagagauuggcaacggcugcuucgaauucuaccacaaaugcgacaacaccugcauggaaucgguaaaaaacggcacuuacgacuaccccaaauacagcgaagaagccaaacucaaccgugaaaaaauagacggcguaaaacucgagagcacccggaucuaccaaauccuggccauauacagcaccgucgccuccucacucguccuggucgucucccucggcgcaaucagcuucuggaugugcagcaauggaucacuacagugcagaaucugcauauaa

SEQ ID NO: 215699 - RNA, 1701 nt, Artificial Sequence
  derived and/or modified sequence opt from Influenza A H1N1 hemagglutinin
augaaagccaucaucgucguacuacucuacaccuucgcgaccgccgacgcggauacccucuguaucggauaccaugccaacaacucaaccgacaccguagacacaguacucgagaaaaacguaaccguaacgcauucagucaaucuacucgaaaacaaacacgauggcaaacucugcaaccugaaaggagucgccccacuccaccucggcaaaugcaacaucgccggauggcugcuaggaaaccccgaaugcgaaucacuauucaccgcuuccuccugguccuacaucguagaaacgcccaacuccgacaacggcacaugcuacccaggcgacuucaucaacuacgaagaacuccgagaacaucucucaucagucuccuccuucgaacgcuucgaaauuuuuccaaaagugaacuccuggcccaaccacgauacaaacaaaggcgucaccgcagccugccccuacgccggagccaacagcuucuaccgaaaucugaucuggcuagucaagaaaggcaacucuuaccccaaacuuuccaaaucuuacaucaacaacaaaaagaaagaaguccuagucaucuggggaauccaccacccacccacaucaacagaccaacaaacccucuaccaaaacgccgacgccuauguguucguaggaucuucaaaauacuccaaacgcuucgaacccgaaaucgccgcacgccccaaaguccgcaaccaagccggccgcaugaacuauuacuggacccucaucgaacccggcgacacaaucacauucgaagccaccggcaaccugguaguccccagauacgccuucgcaaugcggcgcggcagcggcuccggcaucaucgucucugacgcccccguacacgauugcaacacaaccugccaaaccccaaaaggggccauaaacacaucccuccccuuccaaaacauccacccagucacgauaggcgaaugcccgaaauacgucaaauccacgaaacuacgcauggccaccggccugcgcaacaucccaagcauacaaucacgaggucucuuuggcgcgaucgcaggauuccucgaaggcggauggaccggcaugaucgacggaugguacggauaccaccaccaaaacgaacaaggcuccggguacgcagccgaccaaaaaucgacacaaaaugccauagacggcaucaccaacaaagucaacagcauaaucgagaaaaugaacacccaguucaccgcagucggaaaagaguucucucaacucgagaaaagaaucgaaucacuaaacaacaaagucgacgauggguuccucgacaucuggaccuacaacgcagaaauguugguauuacucgaaaacgaacgaacucucgacuaccacgacucgaacgucaaaaaccuauacgaaaaaguccgcucccaacucaaaaacaaugccaaagaaaucggcaacggaugcuucgaguucuaccacaaaugcgauaacacguguauggaaucgguacgcaacggaaccuacgacuaccccaaauacuccgaagaagccaaacuaaaccgagaagaaauagacggcguaaaacuggaaagugcacgaaucuaccagauccuggccaucuacucaacaguagccucaagccuaguccuccuagucucccuaggcgccgucucauucuggaugugcuccaacgguucgcuacagugccgaaucugcaucuaa

SEQ ID NO: 215700 - RNA, 1695 nt, Artificial Sequence
  derived and/or modified sequence opt from Influenza A H1N1 hemagglutinin
augaaagcaauacucgucguacuucucuacacauucaccaccgccaacgccgacacucucugcauuggcuaccacgcaaacaacucaaccgacaccguagacacaguacuagagaaaaacguaaccguaacccauuccguaaaccuacucgaaaaccgccacaacggaaaauuaugcaaacuccgcggcgucgcuccccuccaccuuggaaaaugcaacaucgccggauggcuccuaggcaaccccgaaugcgaaucccuaucuacagccagcuccuggagcuacauugucgagacauccaacucagacaacgggaccugcuaccccggcgacuucauaaacuacgaagaacuacgcgagcaacucuccucugucagcuccuucgagagauucgaaaucuucccccaaaccuccucauggcccaaccacgacaccaaccguggcgucacagcggccugcccccacgcuggcaccaacuccuucuacagaaaccuugucuggcucgucaaaaagggcaacucuuacucaaaaaucaauaaaucauacaucaacaacaaagaaaaagagguccucguccucugggccauccaccaccccuccaccagcgccgaccagcaaucccuauaccaaaacgcugacgccuauguauucguaggcuccucccguuacucccgcaaauucgaaccggaaaucgcaacacgcccaaaagugcgcgaccaagcuggacguaugaacuacuacuggacccuaguagaaccaggcgacaaaauaacguucgaagccaccggaaaccuagucgccccacgcuaugccuucgcccuaaaacgcaacucaggcucaggcaucaucaucuccgacaccuccguccacgacugcgacacaaccugccaaacaccaaacggagccauaaacaccagccucccauuccaaaacauccaccccguaacuauaggcgaaugcccaaaauacguaaaauccacuaaacuccgaauggccaccgggcuacgcaauauccccuccauccaaucccgcggacucuucggcgccaucgccggauucauagagggcggcuggaccggaaugaucgacggcugguacggcuaccaccaccaaaacgaacaaggcuccggcuacgccgccgaccuaaaaagcacucaaaacgccauagauggcaucaccaacaagguaaacuccgucaucgagaaaaugaacacccaauuuaccgccguuggcaaagaauuuucacaccuggaacgccgaaucgaaaaucuaaacaagaaagucgacgacggauuccuagacaucuggaccuacaacgccgaacuccuaguacuccucgaaaacgaacgcacccucgacuaccaugacucaaacguaaagaaccucuacgaaaaaguacgcucacaacucaaaaacaacgccaaagaaaucgguaacggcuguuucgaguucuaccacaaaugcgacgacaugugcauggaaucagucaaaaacggaaccuacgacuaccccaaauacuccgaagaagcuaaacuaaaucgcgaagaaaucgacggcgucaaacucgaaagcacgcgcauauaccaaauacuggccauuuacucaaccgucgccucgucccuaguccucguaguaucccucggagcuaucagcuucuggaugugcuccaacggcucacuacaaugccgcauauag

SEQ ID NO: 215701 - RNA, 1701 nt, Artificial Sequence
  derived and/or modified sequence opt from Influenza A H1N1 hemagglutinin
augaaaaccauaaucgcgcucagcuacauacucugccuagucuucgcccagaaaauccccggaaacgacaacuccaccgcaacccuaugccuuggccaccacgccgugcccaacggcacaaucgucaaaaccaucacgaacgaccgcaucgaagugaccaacgcaaccgagcuaguacaaaacuccuccaucggagaaauuugcgacagcccccaccaaauccucgacggcgaaaacugcacccucaucgacgcccuccuuggagacccgcaaugcgacggcuuccaaaacaagaaaugggaucucuucgucgaacgcagcaaagccuacucaaacugcuaccccuaugacguaccagacuacgccagccuacgaucacucgucgccagcuccggaacccucgaguucaacaacgaaucauucaacuggaccggcguaacacaaaacggcaccagcagcgcaugcauccgaagaagcuccagcuccuucuucagcagacucaacuggcuaacccaccuuaacuacaccuaccccgcacucaacgucaccaugccaaauaacgaacaauucgacaaacuauacaucuggggcguccaccaccccggaaccgauaaagaccaaaucuuccuguacgcacaaagcuccgggcguauuaccguauccaccaaacgaucccaacaagcggucauccccaacaucggauccagaccccgaaucagagacaucccaucccgcaucuccauauacuggacaaucgucaaaccaggcgacauccuccucaucaacucaacgggaaaucucauagcuccccgcggcuacuucaaaauccgcuccggcaaaucauccaucaugcgcucagacgcaccaaucgggaagugcaaaagcgaaugcaucacccccaacggcuccauccccaacgauaaaccuuuucaaaacgucaaccgcauaaccuacggcgccugcccacgcuacgucaaacacaguacccuaaagcuggcaacaggcaugcgcaacguccccgaaaaacaaacacgagggaucuuuggcgcaauagccggcuucaucgaaaacggcugggaagguauggucgacggcugguauggcuucagacaccaaaacucagaagggcgcggccaagccgcagaccucaaaucuacacaagccgccauugaccaaauaaacggcaaacucaaccgccuuaucggcaaaacgaacgaaaaauuccaucagaucgaaaaagaguucuccgaaguagaaggacgaauacaagaccucgaaaaauacgucgaagacacaaaaaucgaccucuggaguuacaacgccgaacuccucgucgcucucgagaaccaacacacaaucgaccuaaccgacuccgaaaugaacaaguuguucgagaaaacaaagaaacaacuccgcgaaaacgcggaagacaugggaaacggcugcuucaaaaucuaccacaagugcgacaacgcuugcaucggcucaaucagaaauggcaccuacgaccauaacguauacagagacgaagcacucaacaaccgauuccaaaucaaaggaguagaacuaaaaucaggguacaaagacuggauccuauggaucagcuucgccauuucuugcuuccuacuaugcgucgccuuacucggcuucaucaugugggccugccaaaaaggaaacauccgaugcaacaucugcaucuaa

SEQ ID NO: 215702 - RNA, 1701 nt, Artificial Sequence
  derived and/or modified sequence opt from Influenza A H1N1 hemagglutinin
augaaagcaauccugguagucuuacuauacaccuucaccaccgccaacgccgacacccucugcaucggcuaccacgcgaacaacuccacagacaccguugacacaguccuggagaaaaacgucaccgugacccacagcgucaaccuccucgaagacaaacacaacggaaaacugugcaaacugcgcggcgucgccccacuccaccuuggcaaaugcaauauagccggcuggauccugggcaaccccgaaugcgaaagccuaagcacagcaucaucauggagcuacaucguagaaacauccaacuccgacaacgguaccugcuaccccggcgacuucauaaacuacgaagaacucagggaacaacucucauccgucuccuccuucgaacgcuucgaaaucuuccccaaaaccuccuccuggccuaaccacgacucgaacaaaggcguaacagcagccugcccgcacgccggcgcaaaauccuucuacaaaaaccucauauggcuagucaagaaaggcaacuccuacccaaaacucaaucaaucuuacaucaacgacaaaggaaaagaaguccuaguacucuggggcauccaccaccccucaaccaccgcagaccaacaaagccucuaccaaaacgccgacgccuacgucuucgucggcaccucccguuacuccaagaaguucaaacccgaaaucgccacacgcccgaaaguacgagaccaagaaggacgcaugaacuauuacuggacccucgucgaacccggcgauaaaaucaccuucgaagcaaccggcaaccuggucguaccaagauacgccuucaccauggaaagaaacgcaggcagcggcaucaucaucuccgacacaccaguacacgacugcaacacaacaugccaaaccccagagggcgccaucaacacaucccuacccuuccagaacauccaccccauaacaaucggcaaaugcccaaaguacgucaaaagcacaaagcuacgccuagcaaccggacuccguaacguacccucaauacagucgcgaggacucuuuggcgcaaucgcgggcuucauagaaggaggcuggaccggcaugguagacggcugguacggguaccaccaccaaaacgaacaaggcucuggcuacgcagccgaccucaaauccacacaaaacgccaucgacaaaaucacaaacaaagucaacuccgugaucgagaaaaugaacacccaauucaccgccgucggcaaagaguucaaccaccucgaaaaacgcauagaaaaccuaaacaagaaagucgacgacggcuuccuagacaucuggacguacaacgcagaacuacucguacuccucgagaacgaacgcacccuagacuaccacgacagcaacguaaagaaccucuacgaaaaaguacgaaaccaguuaaagaacaacgcaaaagaaaucggcaacggcugcuucgaguucuaccacaaaugcgacaacacaugcauggaaucagucaaaaacgguacauacgacuaccccaaauacagcgaagaagccaaacuaaaccgugagaaaauagacggagucaaacucgaaagcacccgcaucuaucaaauccuagcaauauacucuaccguagccagcucccuaguacucguagucagcuuaggcgccauauccuucuggaugugcucuaacggaagccuacaaugccgcauaugcaucuaa

SEQ ID NO: 215703 - RNA, 1701 nt, Artificial Sequence
  derived and/or modified sequence opt from Influenza A H1N1 hemagglutinin
augaaagccauucucaucguauuacucuacaccuucacaaccgcgaacgccgacacacucugcaucggauaccacgcaaauaacagcaccgacaccguagacacaguccucgagaaaaacgucaccguaacccacuccguaaaccuacucgaaaaccgacacaacggcaaacucugcaaacuacgcggcgucgcaccacuccaccucgguaaaugcaacaucgccggcuggcuacuaggcaaucccgaaugcgaaucccugagcaccgccuccaguuggagcuacaucgucgaaaccuccaauuccgacaauggaacaugcuacccgggagauuucaucaacuacgaagaacuccgagaacaacucucaagcguaagcucauucgaacgcuucgaaaucuuccccaaaacaagcuccuggcccaaccacgacaccaaccgcggcguaaccgccgcaugcccacacgcaggcaccaaaucauuuuacaagaaccuaauauggaucgccaaaaaggguaauuccuaccccaaaauaaacaaauccuacaucaacaacaaagaaaaagaaguccucguacuuugggccauccaccacccaucuaccuccgcagaccagcaaucacucuaccaaaacgccgacgccuacgucuucgucggcagcucucgcuacucccgcaaauucgaacccgaaauagccacacgccccaaaguccgcgaucaagccggacgcaugaacuacuacuggacacucguagaacccggcgacaaaauuacauucgaggcgaccggaaaccugguagcccccagguacgccuucgcacugaagcgaaacagcgguucuggcaucaucaucucggacacgucaguacacgacugcgacaccacaugccaaacaccaaacggcgcaaucaacacgagcuuacccuuccaaaacauccaucccgucaccaucggcgagugccccaaauacguaaaauccacaaaacuacgcauggccacaggucuccgcaacauacccagcauacaaucgcggggccucuucggcgcaaucgcaggcuucaucgaaggaggauggaccggcaugaucgauggcugguacggauaccaccaucagaacgagcagggcagcggcuacgcagccgaccucaaauccacccaaaacgccauagacggcaucacgaacaaagucaacagcgugaucgagaaaaugaacacccaauuuaccgccgucggcaaagaguucucccaccucgaacgacgcauagaaaaccucaacaaaaaggucgacgacggcuuccucgacaucuggaccuacaacgccgaacuacucguucugcucgaaaacgaacgcacacuugauuaccacgacucuaacguuaaaaaccucuacgaaaaaguccgcucccagcucaaaaacaacgccaaagaaauagguaacgguugcuucgaguucuaccauaaaugcgacgacaugugcauggaaagcgucaaaaacggcaccuacgacuaccccaaauacucagaagaagcaaagcucaaccgcgaagucaucgacggaguaaaacucgaauccacccgcauauaccaaauucucgcaaucuacgcaaccgucgccucaagccucguccucgucgucagccucggcgcaaucucguucuggaugugcucaaacggcucacuacaaugcagaaucugcaucuag

SEQ ID NO: 215704 - RNA, 1701 nt, Artificial Sequence
  derived and/or modified sequence opt from Influenza A H1N1 hemagglutinin
augaaagccauccuccucguccuccucuacaccuucaccgcagccaacgccgauacccuaugcauaggauaccaugccaacaauucgaccgacacgguagacacaguccuagagaaaaacgucaccgucacccacagcgucaacuuacuagaaaaccgacacaacggcaaacuuugcaaacuccgcggcguaccaccccuccaccucggcaagugcaauauagcgggauggcugcugggaaaccccgaaugcgaacuccuauucaccgcaucaagcugguccuacauagucgaaacaucaaacagcgacaacggcacaugcuaucccggcgacuucaucaacuacgaggaacuccgagaacaacuauccagcgucuccagcuucgaacgguucgaaauauuccccaaagccucguccuggcccgaccacgaaacgaaucgaggcguaaccgcagccugcccauaugccggggccaacuccuucuaccgaaaccucauauggcucgucaagaaaggcaacagcuaucccaaacuaucaaaaagcuaugucaacaacaaagaaaaagaaguccuaguccucuggggcauacaccacccacccacgagcaccgaccagcaaagucuguaccaaaacgccgaugccuacguauucgugggcucauccaaguacaacaagaaauucaaacccgaaauggccgcacgacccaaaguccgcggccaagcaggacgcaugaacuacuacuggacccuaguagcccccggcgacaccaucaccuucgaagcaaccggcaaccucgucgucccccgcuacgccuucgccaugaagcgcgggagcggaagcggcaucaucauaucggacacccccguccacgacugcaacacuaccugucaaacccccaaaggcgccaucaacacaucacucccauuccaaaacauccaccccguuacaaucggcgaaugccccaaauacgucaaaucaacaaaacuccgcauggccaccggcuuacgcaacauccccuccauacaaucacgaggccucuuuggagcaauagccggcuuuaucgaaggaggauggaccggaaugaucgacggcugguacggauaccaccaccaaaacgaacaaggcagcggauacgccgcagaccgcaaaagcacacaaaacgccaucgacggaaucaccaacaaggucaacucaguaaucgagaaaaugaacacccaauucaccgccguagguaaggaguucaaccaccucgagaaaagaauagaaaaccuaaacaagaaagucgacgacggauuccuagacgucuggacauacaacgccgaacuccuaguacuccuagaaaacgaacgaacacuagacuaccacgacucgaacguuaaaaaucucuacgaaaaagucagaucccagcucaaaaacaacgcgaaagaaauaggcaacggcugcuucgaguucuaccacaaaugcgacgacacaugcauggaauccgucaaaaacggcacauacgacuaccccaaauacagugaagaauccaaacucaaccgugaagaaaucgauggggucaagcuggaaagcacccgaauauaccaaauccucgcaaucuacuccaccgucgccaguagccucguacuauccguaagccuaggcgccaucuccuucuggaugugcuccaacggcucccuccaaugccgcaucugcauauaa

SEQ ID NO: 215705 - RNA, 1701 nt, Artificial Sequence
  derived and/or modified sequence opt from Influenza A H1N1 hemagglutinin
augaaagcaauccuacucguccuucucugcacguucgccgccaccaacgccgacacacucugcauaggcuaccacgccaacaacucaacagacaccgucgacacaguccuggagaaaaacgucaccguaacacauuccgucaaccuauuagaagacagacacaacggcaaacuaugcaaacugggcggcaucgcaccccuccaccucggcaaaugcaauauagccggcuggcuauugggaaaccccgaaugcgaacuucuucucacagucucaagcuggagcuacaucgucgaaaccucaaacagcgacaacggaaccugcuacccaggcgacuuuauaaacuacgaagaacuccgcgaacaacuuucaagcguguccucauucgaacgcuuugaaauauucccaaaaacauccucauggccgaaccaugaaacaaaccgaggcgucaccgccgccugccccuacgccggcgcaaacagcuuuuaccgcaaccuaaucuggcucgucgaaaaaggaaacuccuaccccaaacuaucaaaaucauacgucaacaacaaaggcaaagaaguucuggucuuaugggggauacaucacccucccaccucuacggaccaacaaucccucuaccaaaacgccgacgccuacgucuucgugggcucaagcaaauacaacagaaaauucaaacccgaaaucgccgcacgccccaaaguccgcggccaagcaggccggaugaauuacuacuggacccuaauagagcccggcgacaccaucaccuucgaagccaccggcaaccucgucgucccccgauacgcauucgcaaugaaccgcggauccggaucgggcauaaucaucuccgacgcucccguccacgacugcaacacgaaaugccagacacccaaaggagcuaucaacacuucccugcccuuccaaaacauccaccccgugacaaucggagaaugcccgaaauacguaaaaagcacaaaacuacgcauggccaccggccuccgcaauauacccagcauacagucgcgaggccucuucggcgcgaucgccggcuucauagaggguggcuggaccggcaugaucgacggcugguacggauaccaccaccaaaacgaacaaggaagcggauacgcagcagaccaacgauccacgcaaaacgcuaucgacggcauaacaaacaaagucaacagcgugauagaaaagaugaacacccaguucaccgcugucggcaaagaguucaaccaccuugaaaagagaauugaaaaccucaacaagaaaguagacgacggcuuccuagacaucuggacguacaacgccgaacuacucguccucuuagaaaacgaacgcacccucgacuuccacgacuccaacguaaagaaccucuacgaaaaaguaagaucacaacuccgcaacaacgcaaaagaaauaggcaacggcugcuucgaguucuaccacaaaugcgacgacacauguauggaauccgucaaaaacggcaccuacgacuaccccaaauacucggaagaaagcaaacucaaccgcgaagaaauugacggcgucaaacucgaaucaacccgaaucuaucaaauacuagcaaucuacuccacugucgcauccagccucguccugcucgucucccuaggagcaaucucauucuggaugugcuccaacggcucccuacaaugccgcaucugcaucuaa

SEQ ID NO: 215706 - RNA, 1701 nt, Artificial Sequence
  derived and/or modified sequence opt from Influenza A H1N1 hemagglutinin
augaaagccauccuaguaguacuccuauacacauucgccaccgcgaacgcagacacccucugcaucggauaccacgcaaacaacucaacagacaccguagauacaguucuagagaaaaacguaaccgucacccacagcguaaaccuccuagaagacaaacacaacggcaaacuaugcaaacuccgcggagucgcgccccuccaucuaggcaaaugcaauaucgccggcuggauacuagguaacccagaaugugaaucccuaucaacagcaucguccuggagcuacauagucgaaacgagcuccagcgacaacggaaccugcuacccaggcgacuucauagacuacgaagaacuccgcgaacaacucucaucaguaucaucauucgaacgauucgaaaucuucccaaaaacaaguuccuggcccaaccacgacucgaacaaaggagugaccgccgccugcccccacgcaggggccaaauccuucuauaagaaccucauauggcuugucaagaaaggaaacuccuacccgaaacuauccaaauccuacauuaacgacaaaggcaaagaaguccucguacucugggggauccaccacccaagcacauccgccgaccagcaaucgcucuaccaaaacgcagacgcauauguauucgucggcaccucgcgauauagcaagaaauucaaaccggaaaucgccauccgccccaaaguccgcgaccaagaaggccgaaugaacuacuacuggacccuagucgaaccaggcgacaaaaucaccuucgaggccaccggcaaccuggucgugccacgauacgcauucgcaauggaacgcaacgcagguuccggaaucaucauauccgacacgcccguacacgauugcaacaccacgugccagacacccaaaggcgccaucaauacgagccuacccuuccaaaacauccaccccaucaccaucggcaaaugcccaaaauacgucaaauccaccaagcuccgucucgccacaggccuacgcaacguccccucaauccaaucgcgcggccucuucggcgccaucgcgggauucaucgagggaggcuggaccggcaugguagacggcugguacggauaccaccaccagaacgaacaaggcucaggauacgcugcagaccucaaaagcacccaaaacgccaucgacgaaauaacgaacaaaguaaacuccguaaucgagaaaaugaacacacaguucaccgccgucggaaaggaguucaaccaccucgaaaagcgcauagaaaaccucaauaagaaagucgacgacggcuuccucgacauuuggacauacaacgccgaacuacucguccuacuagaaaacgaacgcacacuagacuaccacgauucaaacgucaaaaaccucuacgaaaaaguccgaagccaacucaaaaacaacgccaaggaaauaggcaacggcugcuucgaguucuaccacaagugcgacaacacaugcauggaauccgucaagaacggaacauacgacuacccaaaauacagcgaagaagccaaacucaaccgagaagaaauugacggaguaaaacucgaaagcacccgcauauaccagauccucgccauauauuccaccguagccuccagccucgucuuagucguaagccucggcgccaucuccuucuggaugugcucaaacggcucccuccaaugcagaaucugcaucuaa

SEQ ID NO: 215707 - RNA, 1701 nt, Artificial Sequence
  derived and/or modified sequence opt from Influenza A H1N1 hemagglutinin
augaaagcaauccucguaguccuccucuacaccuucgccaccgcgaacgcagacacgcuuugcaucggcuaccacgccaacaacucgaccgacacuguagacacaguacucgaaaagaacgugaccguaacacacuccguaaaccuucuggaagacaaacacaacgguaaacucugcaaacuccgaggagucgcaccccuccaccugggaaaauguaacauagccggcuggauacuaggcaaccccgaaugcgaaagucuguccacagccuccagcugguccuacaucguagaaacauccucaagcgacaacggaaccugcuaccccggagacuucauagacuacgaggagcuccgagaacaacucucaagcgucuccucauucgagcgcuucgaaauauucccaaaaacauccuccuggccuaaccacgacuccaacaaaggaguuaccgccgcaugcccccacgccggagcuaaauccuucuacaaaaaccucauauggcucgucaagaaaggaaacagcuacccuaaacuuucaaaaucguacaucaacgacaaagggaaagaaguccugguacucuggggcauccaccaccccuccaccagcgccgaccaacaaucgcuuuaccaaaacgccgacgccuacgucuucgucggauccucccgauacuccaagaaauucaaaccagaaaucgccauccgaccaaaaguccggggccaggaaggccgcaugaacuacuacuggacccucgucgaaccaggcgacaaaaucaccuucgaagcaaccggaaaccucgucguaccccgcuaugcauucgccauggaacgaaacgccggaagcggcaucaucauauccgacacgccugugcacgacugcaacacaaccugccaaacacccaaaggagccauaaacaccagccuccccuuucaaaacauacaccccauaacuaucggaaaaugcccuaaauacguuaaauccacaaagcuacgucucgccacgggccuaagaaacguaccaucaauccaaucacgcggacucuucggcgcaauagccggcuucaucgaaggcggcuggacaggcauggucgacgggugguacggguaccaccaccagaacgaacaaggcuccggguacgccgcagacuuaaaguccacacagaacgcaaucgacgagaucacgaacaaagucaacuccguaaucgaaaagaugaacacacaauucaccgcggucggaaaggaguucaaccaccucgaaaaacgaauagaaaaccucaacaagaaagucgacgacggcuuccuagacaucuggaccuauaacgcagaacuacucguacuacucgagaacgaacgcacacucgacuaccacgauuccaacgucaaaaaccuauacgaaaaaguccgcucccaacucaaaaacaacgccaaagagaucggaaacggcugcuucgaguucuaccacaaaugcgacaauaccugcauggaaucuguuaaaaacggcaccuacgacuaccccaaauacuccgaagaagccaaacucaacagagaagaaauagacggcgucaaacuagaaucaacacgaauauaccaaauccuagccaucuacucgaccgucgcaucaucgcuaguccuggucguaagccuaggcgccaucuccuucuggaugugcagcaacggcucauuacagugcagaaucuguaucuaa

SEQ ID NO: 215708 - RNA, 1704 nt, Artificial Sequence
  derived and/or modified sequence opt from Influenza A H1N1 hemagglutinin
auggagaaaauaguccugcuccuagccgucaucucccucgucaaauccgaccaaauuugcaucggauaccacgccaacaacucuaccaaacaaguagacaccauuauggaaaagaacgucaccgucacccacgcccaagacauccucgaaaagacacacaacggaaaacuaugcgaccuaaauggcgucaagcccuuaauccuaaaagacugcagcguagcaggguggcuccucggcaaccccaugugcgacgaauuuaucagaguccccgaauggagcuacauaguagaacgcgccaaccccgccaacgaccucugcuaccccgggacucucaacgacuacgaagaacucaagcaccuccucagccgcaucaaccacuucgagaaaaaccuaaucauacccagguccuccuggccaaaccacgaaaccagccuaggcgucuccgccgccugcccauaccaaggcgccucaucuuucuuccgcaacgucgucuggcucaucaagaaaaacgacgccuaccccacuaucaaaaucuccuacaauaauaccaaccgcgaagaccuccuaauccuauggggcauccaccacuccaacaacgccgccgaacaaaccaaccucuacaaaaacccagacaccuacguauccgucggcacaucaacacucaaccaacgacucguccccaaaaucgcgacuagaagccaaguuaacggccaauccggccgcauggacuucuucuggacaauacuaaaaccaaacgacgcaauacacuucgaaagcaacggcaacuucauagcccccgaauacgccuacaaaaucguaaagaaaggcgacuccaccauaaugaaaagcgaaauggaauauggccacugcaacacgaaaugccaaacccccaucggcgccaucaacagcuccaugccauuccacaacauccacccucuuaccaucggagaaugccccaaguacgucaaaucuaauaaacucguccucgcaacaggacuacguaacagcccccuccgagaacgccgccgcaagcgcggacucuucggcgccaucgccggcuucaucgaagguggcuggcaaggaauggucgacggcugguacggcuaccaccacucgaacgaacaaggcagcggcuacgcggccgacaaagaguccacccaaaaagccauagacggaguaaccaacaaagucaacucaaucaucgacaaaaugaacacacaguucgaagcgguuggccgcgaguucaacaaccuagaacgaagaaucgaaaaccuaaacaagaaaauggaagacggcuuccucgacgucuggacauacaacgccgaacuccucguacugauggaaaacgaacgaacccuagacuuccacgacuccaacgugaaaaaccucuacgacaagguccgacugcaacuacgcgacaacgccaaagaacucggcaacggauguuucgaguucuaccacaaaugcgacaacgaaugcauggaaagcguucgcaacggcaccuacgacuacccaaaauauucagaagaggcaauccuuaaaagggaagaaaucaguggagucaaacucgaauccauaggcaccuaccaaauccuuucaaucuacuccaccgucgccucaucacucgcccuagccaucauaguagcaggccuaucccuauggaugugcagcaacggcucacuccagugccgcaucugcauauag

SEQ ID NO: 215709 - RNA, 1701 nt, Artificial Sequence
  derived and/or modified sequence opt from Influenza A H1N1 hemagglutinin
augaaagccauacucgucguacuccuauacaccuucaccacugccaacgcagacacauuaugcaucggcuaccacgccaacaauagcacggacaccgucgacacaguucuugaaaagaacguaaccgucacccacagcguaaaccuacuagaaaaccgccacaauggcaaacuaugcaaacugcguggcguagcaccacuccaccucggcaaaugcaacauagccggauggcuucucggcaaccccgaaugcgaaucccucuccaccgccucauccuggucauacauagucgaaaccucaaacuccgacaacgggaccugcuacccaggcgacuucaucaacuacgaagaacuucgagagcaacucuccagcgugucaucauucgaacgauucgaaauauucccaaaaacaagcuccuggccaaaccacgacacgaaccgcggcgucaccgcagcauguccccacgccggcaccaauucauucuaccguaaccucaucuggcucgucaagaaaggcaacagcuaccccaaaaucaacaaaucauacaucaacaacaaagaaaaagaaguccuaguccuaugggccauacaccacccgucuaccuccgccgaccaacaaagccucuaccagaacgcagacgcauacguauucgucggauccucacgauacuccagaaaauucgaaccagaaauagccacccgaccaaaaguccgcgaccaggcuggacgcaugaauuacuacuggacccuagucgaaccgggggacaaaaucaccuucgaagcaacaggaaaccucgucgucccacgcuacgcauucgcgcucaaacgcaacagcggcucuggaaucaucauauccgacaccagcguccacgacugcgacacuacaugccaaacaccaaacggcgccaucaacacaucccucccauuccaaaacauacaccccgucaccaucggcgagugcccgaaauacgucaaguccaccaagcuacguauggccacaggccugcguaacauccccagcauacaaucacgcggucuauucggagcgaucgccggauuuauagaaggcggcuggaccggcaugaucgacggcugguacggcuaucaucaucaaaacgaacaggggucuggcuacgccgccgaccucaaaucaacucaaaacgccauagacgggaucaccaacaaagucaacuccgucaucgagaaaaugaacacacaauucaccgcaguaggcaaagaguucucccaccucgaaaggcggauagaaaaccuaaacaagaaaguagacgacggauuccuagacauauggacauacaacgccgaacuccucguccuacucgaaaacgaacgcacccucgacuaccacgacucaaacgucaaaaaccucuacgaaaaaguccgcagccaacucaaaaacaacgcaaaagagaucggcaacggcugcuucgaguucuaccacaaaugcgacgauaccugcauggaaucagucaaaaacggaaccuacgacuaccccaaauacagcgaagaagccaaacuaaaccgagaagaaaucgacggcguaaaacucgaaucgacacgcauauaccaaauacuagcuaucuacucaaccguagcguccagccuaguccucgucguaucacucggcgccauaucauucuggaugugcuccaacggcucccuccagugccgcaucugcaucuaa

SEQ ID NO: 215710 - RNA, 1701 nt, Artificial Sequence
  derived and/or modified sequence opt from Influenza A H1N1 hemagglutinin
augaaagccauccuggucguccugcuauacaccuucacaaccgcaaacgcagacacacuuugcaucggauaccacgcuaauaacagcaccgacaccgucgacaccguccucgaaaaaaaugucaccgucacccacuccgucaaccuccucgaaaaccgccacaacggaaaacuaugcaaacuccgcggaguagccccccuccaccugggcaaaugcaacaucgccggcuggcuucucggcaaccccgaaugcgaaagcuuaucaacagccucuagcuggucuuacauagucgaaacgaguaacagcgacaacggcaccugcuaccccggagacuucauaaacuaugaagaacuccgcgaacaacucuccuccguaucaucauucgaacgcuucgaaaucuucccaaaaaccagcucuuggccgaaccacgacaccaaccgaggagucaccgcggccugcccccacgccggaaccaacagcuucuaccgcaaccugaucuggcucguuaaaaaaggaaacuccuaccccaaaaucaacaaauccuacaucaacaacaaagaaaaagagguccugguccuaugggccauccaccacccauccacgagcgccgaccaacaaucacucuaccaaaacgccgacgcauacguauucguugggagcagcagauacucgagaaaauucgaaccagaaaucgccacccguccuaaaguacgcgaccaagccggacgaaugaacuacuacuggacacuugucgaacccggggacaaaaucaccuucgaagcgaccggaaaccuagugguacccagauacgccuuugcccuuaaacgcaacuccggcagcggcaucaucaucucagacacgagcguccacgacugcgacacaacgugccaaacccccaacggugccaucaacaccucccucccauuccaaaacauacaccccguaaccaucggcgaaugcccgaaauacgucaaguccacaaaacuaagaauggccaccggcuuacgcaacauuccaucaauccaaucccgcggacuuuucggagcgaucgccgguuucaucgagggcggcuggacuggcaugaucgacggcugguacggauaccaccaccaaaacgaacagggcagcggauacgccgccgaccucaaaagcacacagaaugcaaucgacggaaucacaaacaaagucaacuccguaauagaaaaaaugaacacccaauucacagccgucggaaaagaauucucacaccucgaacgacgcaucgaaaaucucaacaaaaaaguagacgacggauuccucgacaucuggaccuacaacgcagaacuccuaguccuccuagaaaacgaaagaacccucgacuaccacgauucgaacgucaaaaaccuuuacgaaaaaguaaggagccaacucaaaaacaacgccaaagaaauaggaaacggaugcuucgaauucuaccacaaaugcgacgauacaugcauggaauccgugaaaaacgggacauaugacuaccccaaauacucagaagaagcaaaacuuaacagagaagaaaucgacggcgucaaacucgaauccacacgcaucuaccaaauccucgccauauacuccaccgucgcuucaagccucguccucgucgucagccucggugcgauuucguucuggaugugcucaaacggcucccuccaaugccgcaucugcaucuaa

SEQ ID NO: 215711 - RNA, 1701 nt, Artificial Sequence
  derived and/or modified sequence opt from Influenza A H1N1 hemagglutinin
augaaagcaauccucauaguucuacuauacaccuucacaaccgcaaacgccgacaagaucugcaucggcuaccacgcaaacaacucaaccgacacugucgacacgguacucgaaaagaacguuaccguaacccacagcgucaaccuacuagaaaacaaacacaacggaaaacucugcaaacuacgaggaguagcaccccuccaccuaggaaaaugcaauaucgcaggauggcuacuaggcaaccccgaaugcgaaucacucgcaacagccuccagcuggagcuacaucguagaaaccagcuccucaaacaacggaaccugcuacccaggagacuucauuaacuacgaggaacuccgcgaacaacucagcuccgugucauccuuugaaaaauuugaaaucuuccccaaaacaucgucauggccaaaccacgaaaccaacaaaggagucacggcagcuugcccacacgcaggcacgaauagcuucuacaaaaaccugauauggcuugucaagaaagaaaacagcuaccccaaaauaaacauaucauacaccaacaaccgcggcaaagaaguacucguacuaugggccauccaccacccacccaccagcaccgaccaacaaucccuauaccaaaacgccaacuccuaugucuucgucgggagcagccgcuacucccgaaaauucgaacccgaaauagcaacacgcccaaaaguccgaggccaagccggccgcaugaauuacuacuggacucuugucgaaccuggagacaaaauaaccuucgaggcaaccggcaaccuaguaguccccagauacgcguucgcccucaaacggaacuccggcucaggcaucaucaucuccgaaacuccuguacacgacugcgacaccacaugccaaaccccaaacggcgccaucaacacaagccuacccuuccaaaacauacacccagucacaaucggcgaaugccccaaauacguaaaaucaaccaaacuacgcauggcaaccggccuccgcaauauccccuccauccagucgcgaggccucuucggagccaucgccggcuucauagaaggcggguggaccggcaugaucgacggcugguauggguaccaucaccaaaacgaacaaggcucaggauacgcagcagaccucaaauccacccaaaacgccaucgacggcaucaccaacaaagugaacucagucauugagaaaaugaacacacaauucaccgccgucggaaaagaguucucacaccucgaacgacgcaucgaaaaccuaaacaagaaagucgacgacggauucauagacaucuggaccuacaacgccgaacuccucgugcuccucgaaaacgaacgcacacuagacuaccacgacuccaacgucaaaacacuauacgaaaaaguccgcucccaacucaaaaacaacgccaaagaaauaggaaacggcugcuucgaguucuaccacaaaugcgacgacacaugcauggaaucagucaaaaauggcaccuacgacuacccuaaauacucggaagaagccaaacuuaaccgggaagaaaucgacggaaucaaacuggaaagcacccgcaucuaccaaauccuggccauauacuccaccguagccucaagccuaguccucguagucucccuaggagcaauauccuucuggaugugcuccaacgguucccugcagugccgcgucugcauauga

SEQ ID NO: 215712 - RNA, 1701 nt, Artificial Sequence
  derived and/or modified sequence opt from Influenza A H1N1 hemagglutinin
augaaagccauccuccuaguccuacucuacaccuucaccgccgcgaacgccgacacgcuuugcauaggcuaccacgcaaacaacucuaccgacaccguagacaccguccuagagaaaaacgucaccgucacccacuccguaaaccuccucgaagaccgccacaacggaaaacuaugcaaacuacgcggggucgcaccccuucaucucggcaagugcaacaucgccggguggcuacucggcaaccccgaaugcgaacuccucuucaccgcaucguccuggucauacaucgucgaaacaucaaacuccgacaacgggaccugcuaccccggggacuucauaaacuacgaagaacuacgggaacaacucucaucaguauccucauucgaacgauucgaaaucuucccaaaagccuccuccuggcccaaccacgaaacaaacagaggcgucaccgcugcaugccccuacgccggugccaacagcuucuaccgaaaccucaucuggcucgucaagaaaggcaacucguacccaaaacucagcaaaagcuacgucaacaacaaagaaaaagaaguccuaguccucuggggcauccaccacccacccaccucaaccgaccaacaaagccucuaccaaaacgcggacgccuacgucuucgucggcuccuccaaauacaacaagaaauucaaacccgagaucgccacgagacccaaagugcgaggccaagcuggucgaaugaacuacuacuggacccuaguagaaccuggcgacaccauaaccuucgaagccaccggcaaccuuguugucccgcgcuacgcguucgcaaugaaacgcggaagcggaagcggcaucaucauaucagacacaccgguacacgauugcaacaccaccugucaaacccccaaaggcgccaucaauaccucccuaccauuccaaaauauacacccagucaccaucggcgaaugccccaaauacgucaaauccacgaaacuacgcauggccacuggccuccgaaacauaccuucaauacaaucucgcggccucuucggcgcaauagcaggauucaucgaaggcggauggacaggcaugaucgacggcugguacggcuaccaccaccaaaacgaacaaggcagcggcuacgcugccgacagaaaauccacacaaaacgccaucgacgguauaaccaacaaaguuaacuccguaaucgaaaagaugaacacgcaauucaccgcagucggcaaagaguucaaccaccucgaaaaacgaauagaaaaccucaacagaaaggucgacgacggcuuucuagacaucuggacauacaacgccgaacuccugguacuccuagaaaacgaacgcacccuagacuaccacgacuccaacgucaaaaaccuuuacgaaaaaguacgaucccaacucaaaaacaaugcaaaggaaauaggaaacgguugcuucgaguucuaccacaaaugcgaugacacaugcauggaauccgucaaaaacggcaccuacgacuaccccaaguacagcgaagaauccaaacuaaaccgcgaggaaaucgacggcgucaaacuagaaagcacgcgcauauaccaaauccuagcaaucuacuccacaguagccuccagccuaguucuccucguaucacuaggagcaaucucauucuggaugugcaguaacggcucccuccagugcagaauauguaucuaa

SEQ ID NO: 215713 - RNA, 1698 nt, Artificial Sequence
  derived and/or modified sequence opt from Influenza A H1N1 hemagglutinin
augaaagccaaccuccucguacuccuaugcgcacuugccgccgcagacgcagacacaauaugcaucggauaccacgcaaacaacuccaccgacacugucgacaccguccuggagaaaaacguaacugucacccacuccgucaaccuccuagaagacagccacaacggcaaacugugucgucucaagggaaucgcaccccuccaacucggcaaaugcaacauagccggguggcuccuaggcaaccccgaaugcgacccacucuuaccaguacgcucguggucauacaucgucgagaccccuaauuccgaaaacgguaucugcuacccaggcgacuucaucgacuacgaagaacuucgcgaacaacuauccagcgucagcagcuucgaacgauucgaaaucuuccccaaagaaagcucauggccaaaccacaacaccaacggcgugaccgccgcaugcucccacgagggcaaaucaucauucuacagaaaccuccucuggcucacagaaaaagaaggcucuuacccaaaacuaaagaacuccuacgucaacaagaaaggcaaagaaguacugguacuguggggcauccaucacccacccaacucaaaagaacaacaaaaccucuaccagaacgaaaacgccuaugucagcguugucacaucuaacuacaaccgccgcuucacgcccgaaauagcagaaagacccaaagugcgcgaucaagcuggccgcaugaacuacuacuggacacuccucaaacccggcgacaccaucauuuucgaagcaaacggcaaccucauagcccccauguacgcguucgcccugucucgcggcuucggcuccggcauaaucaccuccaacgccuccaugcacgaaugcaauacaaaaugccagacaccccucggcgccaucaacucgucccuccccuaccaaaacauccaccccgucaccauuggcgaaugcccaaaauacguuagaagcgcaaaacuccgaauggucaccggccuccgcaacaaccccagcauacaaucccgaggacucuucggagccaucgccggauucauagaaggcggauggaccggcaugauagacggaugguacggcuaccaccaccaaaacgaacaaggauccggauacgcggccgaccaaaaaucaacccaaaaugcaaucaauggcaucacaaacaaagucaacacugucauagagaaaaugaacauccaauucaccgccgucggcaaagaguucaacaaacuagaaaagagaauggaaaaccuaaauaaaaagguagacgacgguuuccuagacaucuggacauacaacgcagaacuccuaguccuucucgaaaacgaacgaacacucgacuuccacgacagcaacgucaaaaaccucuacgaaaaagucaaaagccagcucaaaaacaacgccaaagaaaucggcaacggaugcuucgaguucuaccacaagugcgacaacgaaugcauggaaucugucagaaacggcaccuacgacuaccccaaguacuccgaagaauccaaacucaaucgcgaaaaagucgacggcguaaaacucgaauccauggggaucuaccagauccucgccaucuacagcacaguggccucaucccugguccugcuagucagccucggcgcuaucuccuucuggaugugcucuaacggcucccuacaaugccgaaucugcaucuaa

SEQ ID NO: 215714 - RNA, 1701 nt, Artificial Sequence
  derived and/or modified sequence opt from Influenza A H1N1 hemagglutinin
augaaagcgauacucgugguacuccucuacaccuucgcaaccgcaaacgccgacacccugugcaucggauaccacgcaaacaacucaacagacaccguagacaccguacucgagaaaaacgucaccguaacccacagcguaaaccuacucgaagacaaacacaacggaaagcugugcaaacuucguggcgucgcaccccuucaccuaggaaaauguaacaucgccggcuggauccucggaaacccggaaugcgaaucccucagcacagcauccuccuggucuuacauagucgaaaccuccucaucagacaacggcacaugcuacccaggcgacuucauagacuacgaagaacuaagagaacaacucuccagcgucuccagcuucgaacgcuucgaaauauuccccaaaacgagcagcuggcccaaccacgacuccaauaagggcguaacagcagcgugcccacacgccggagcuaagagcuuuuacaaaaaccucaucuggcucgucaagaaaggaaacagcuacccaaaacucucgaaaucauacaucaacgacaaaggcaaagagguccuaguacucugggggauccaccaccccagcacuuccgcagaucagcaaagccuauaccaaaacgccgacgccuacgucuucgucggcagcucccgcuacagcaagaaauucaaaccugaaaucgcaauccgccccaaagugcgagaccaggagggacgaaugaacuacuacuggacgcuugucgagcccggcgacaaaaucacuuucgaagccaccggcaaccuagucgucccccgcuacgccuucgccauggaaagaaacgccggcucuggcaucauaaucuccgacacccccguacacgacugcaacacaaccugccagacccccaaaggcgcaaucaacaccucacucccauuccaaaacauccaccccauaaccauaggcaaaugccccaaguacgucaaguccaccaaacuucgcuuggccaccggccuacgcaacguccccagcauccagucaagaggccuauucggcgcaaucgccggcuuuauagagggaggcuggacaggcaugguugacggcugguacggguaccaccaccaaaacgaacagggauccggcuacgccgcagaccuaaaaagcacccaaaacgccauagacgagauaacgaacaaaguaaacucaguuauagagaaaaugaacacacaauucaccgccgucgguaaagaguucaaucacuuagaaaaacgcaucgaaaacuuaaacaaaaaggucgacgacggauuccucgacaucuggaccuacaacgccgagcuccucguccuccucgaaaacgaacgcacacuugacuaccacgacuccaacgucaaaaaccuauacgaaaagguaagaagccaacucaaaaacaacgccaaggaaauagggaacgggugcuucgaguucuaccacaaaugcgacaacacauguauggaaucagucaaaaacggaaccuacgacuaccccaaauacucggaagaggccaaacuaaaccgcgaagaaaucgacggcguaaaacuagaguccacgcgcauauaccaaaucuuagcaauauacuccaccgucgccucaucccuuguccuagucgucagccuaggagccaucuccuucuggaugugcagcaauggcucccuacaaugccgcaucugcaucuag

SEQ ID NO: 215715 - RNA, 1701 nt, Artificial Sequence
  derived and/or modified sequence opt from Influenza A H1N1 hemagglutinin
augaaggcaauccucguaguccuccuauacaccuucaccaccgccaacgccgacacccucugcaucggauaucacgcaaacaacuccacagacaccguagacacaguacuagagaaaaacguaaccgucacccacuccgucaaccuacucgaagacaagcacaacggcaaacuaugcaaacuccgcggcguggcaccccuccaccugggaaaaugcaacauagccggcuggaucuugggcaaucccgaaugcgaaucccucagcacagccagcuccuggagcuacaucgucgaaacaagcaacucugacaacggcacaugcuacccaggagacuucaucaacuacgaagaacuccgugaacaacucuccagcgucuccuccuucgagcgcuucgaaaucuuccccaagacaagcucauggccaaaccaugauucaaacaaaggcgucaccgccgcgugcccccacgccggcgccaagagcuucuacaaaaaccucaucuggcucgugaagaaaggcaauucuuacccaaaacucaaucaaucuuauaucaacgacaaaggcaaagaaguccugguccucuggggcauacaccaccccucaaccacagcggaccagcaaucccuauaccagaacgccgacgccuacgucuucgucggcacaucacgcuacagcaagaaauucaaaccagaaauagccacccgccccaaaguccgcgaccaagaaggccgcaugaacuacuacuggacacucgucgaacccggagacaaaauuaccuucgaagccacagggaaccucguuguaccacguuacgcauucaccauggagagaaacgccggcucaggcauaauaaucucagacacaccaguccacgacugcaacaccacuugccaaacacccgaaggagcgauaaacaccagccuacccuuccaaaacauccacccaauaacaauaggaaaaugcccaaaauacgucaaauccaccaaacuccgccuagcuaccggccuaagaaacgugccauccauccaaucccgcggccuauucggcgcaaucgccggcuucauagaaggcggauggaccggcaugguugacggcugguacggcuaccaccaccaaaacgaacaaggcuccggcuaugccgccgaccucaaaucgacccaaaacgcaauugacaaaauaaccaacaaagucaacagcgucauagaaaagaugaacacccaauucaccgcagucggcaaagaguucaaucacuuagaaaaacgaauugaaaaccucaacaagaaagucgacgacggauuccuagacaucuggaccuacaacgcagaacugcucguccuacuagagaacgaacgaacccucgauuaccacgacuccaacgugaaaaaccuguacgaaaaaguccgaaaccaacucaaaaacaacgcaaaggaaaucggaaacggaugcuucgaauuuuaccacaaaugcgacaauaccugcauggaaagcguaaagaacggcaccuacgacuaccccaaauacucagaagaagccaaacuaaaccgcgaaaagauagacggagucaaacuugaauccacacgaauauaccaaauccucgcuaucuacucgaccguggccuccucccuagugcucguaguaucacuuggcgccaucagcuucuggaugugcucaaacggaagucuucaaugccgcaucugcauauaa

SEQ ID NO: 215716 - RNA, 1701 nt, Artificial Sequence
  derived and/or modified sequence opt from Influenza A H1N1 hemagglutinin
augaaagcaauccuagucguacugcucuacacauucacaaccgcuaacgccgacacccugugcauaggcuaccacgccaacaacucaacagacaccguagacacaguccuagaaaagaauguaacagucacccacuccguaaaccuccucgaagacaaacacaacggaaaacucugcaaacuccgcggcguugcaccccuccaccucggcaaaugcaacaucgccggcuggauccucggcaacccagaaugugaaucccuaucaacagccucaagcugguccuauaucgucgaaaccuccaacucagacaacggcacaugcuaccccggcgacuucauaaacuacgaagaacuccgcgaacagcuaucuucagucucaucauucgaacgcuucgaaaucuuccccaaaacgagcuccuggccaaaccacgacucaaacaaaggcgucaccgcagccugcccucacgccggagcgaaguccuucuacaaaaaccucaucuggcucgucaagaaaggcaacuccuacccaaagcuaaaccaauccuacaucaacgacaaaggcaaggaaguacucguccuguggggaauccaccacccgagcaccacggcagaccaacagucccuauaccaaaacgccgacgccuacgucuucgucggcacaucccgauacucuaagaaauucaaaccagaaaucgccacgcgacccaaaguacgagacagagaaggccgcaugaacuacuacuggacccucgucgaaccuggcgacaaaaucaccuucgaagccaccggaaaccucgucgucccccgcuacgcguucacaauggaacguaaugcagguuccggcaucauaaucagcgacacaccuguccacgacugcaauaccacaugccaaacaccagaaggcgccaucaacaccucacugccuuuccaaaacauccaccccaucaccauaggcaaaugccccaaauacgucaaaucuacgaaacuucgccucgccaccggccuccgcaacguccccuccauccagucacgcgggcuauucggagccaucgcaggguucaucgaaggaggcuggaccggcauggucgauggaugguacggcuaccaccaccaaaacgaacaaggcucgggauacgccgccgaccuuaaaucaacccaaaacgccauagacaaaaucacgaacaaagucaacuccgucauagagaaaaugaacacccaguucaccgcagucggcaaagaguucaaccaccuagaaaaacgaaucgaaaaccucaacaagaaagucgacgacggauuccucgauaucuggaccuacaacgccgaacuccucguccuccucgaaaacgaacgcacacuagacuaccacgacuccaacgucaaaaaccuauacgaaaagguccgaaaucaacucaaaaacaacgccaaggaaaucggcaacggcugcuucgaguucuaccacaaaugcgacaacacgugcauggaauccgugaagaauggaaccuacgacuaccccaaauacuccgaagaagcaaaacucaaccgcgagaaaaucgacggagucaaacuagaauccacgcgcauauaccaaauccucgcaaucuacucaaccgucgcaucgagcuuaguccuggucgucucccugggagcuauaucguucuggaugugcuccaacggcagccuucaaugccgaaucugcaucuaa

SEQ ID NO: 215717 - RNA, 1701 nt, Artificial Sequence
  derived and/or modified sequence opt from Influenza A H1N1 hemagglutinin
augaaggccauucucguaguccuacucuacaccuucacaacagcaaacgccgacacccucugcaucggauaccacgccaacaacucaacggacacaguagacacaguacuagagaaaaacgucaccguaacccacucuguaaaucuccuagaagacaaacacaacggcaaacuaugcaaacuacgcggagucgcaccacugcaccucggcaaaugcaacaucgcaggcuggauccugggcaacccugaaugcgaaucccuaucaaccgccucauccuggagcuacaucguagaaacauccaacuccgacaacggcacauguuacccaggcgacuuuaucaacuacgaagaacuacgcgaacaacugucauccguauccucauucgaacgauucgaaauauuccccaaagccucaucauggcccaaccacgacuccaacaaaggcgucaccgcagccugcccccacgccggcgccaaauccuucuacaaaaaccucaucuggcucgucaagaaaggcaauagcuauccaaaacuuaaccaauccuacaucaacgacaaaggcaaagaaguacuuguucuauggggcauccaccaccccucaacaacagccgaccaacaaucccuuuaccaaaacgccgacgccuaugucuucguaggcaccucacgcuacucaaagaaauucaaaccagaaaucgccacccgacccaaaguccgcgaucaagaaggccgcaugaacuauuacuggacacucgucgaaccaggcgacaaaauaacauucgaagccaccggcaaccuagucguccccagauacgcauucacgauggagcgcaacgcaggcagcggcaucaucaucuccgacaccccaguacacgacugcaacacaaccugccagaccccagaaggcgccauaaacaccagccuccccuuccaaaacauacacccaauaaccauaggcaagugccccaaguacgucaaaagcaccaaacugagacuggcuaccggccuucgcaacguucccucaauccaaucccgcggccuauucggcgcaaucgccggcuucaucgaagguggcuggaccggcauggucgacggaugguacggcuaccaccaccaaaacgaacaaggaagcggcuacgcggccgaccuaaaaagcacccaaaacgccaucgacaaaaucacuaacaaagucaacuccguaaucgagaaaaugaacacacaauucaccgccgucggaaaagaguucaaccaccuagaaaagcgcaucgaaaaccucaacaagaaagucgacgacggcuuccucgacaucuggaccuacaacgccgaacuccuaguacuacucgaaaacgaacgcacacucgacuaucacgacucaaacgucaaaaaucuauaugaaaaaguccgcaaccaacucaagaacaacgccaaagaaaucggcaacggaugcuucgaguucuaccacaagugcgacaacacgugcauggaauccgucaaaaacggaacauacgacuaccccaaauacuccgaagaagcgaaacuaaaucgcgagaaaaucgacggagucaaacuagaaagcacccgcauauaccaaauccuagcaaucuacagcacaguugccagcucccuaguccuugucgucagccucggagcaaucagcuucuggaugugcuccaacggcucccuccaauguaggaucugcaucuga

SEQ ID NO: 215718 - RNA, 1701 nt, Artificial Sequence
  derived and/or modified sequence opt from Influenza A H1N1 hemagglutinin
augaaagccauauuaguaguccuccucuacaccuucaccacagcgaacgccgacacccuuuguaucggauaccacgcaaacaacuccacugacaccguggacacaguccuagaaaagaacguaaccguaacacacucggucaaccugcucgaagacaaacacaacggcaaacuaugcaaacuacgcggagucgcaccccuucaccuuggcaaaugcaacauagccggcuggauccucggaaacccagaaugcgaaagccuaagcaccgccucaagcuggucauacaucgucgaaaccuccaacagcgacaacggaaccugcuacccaggcgacuucaucaacuacgaagaacuccgagaacagcucuccuccguauccucauuugaacgcuucgaaauauucccaaaagccuccucauggcccaaucacgacucaaacaaaggcguaacagcugcaugcccccaugccggugccaaaucauucuacaaaaaccuaaucuggcucgucaagaaaggcaacuccuaccccaaacugaaucaauccuacaucaacgacaaaggaaaggaaguccuaguccuauggggaauccaccacccgucuacaaccgcagaucaacaaagccuauaccaaaacgccgacgccuacgucuucgucggcaccucgcgcuacagcaagaaauucaaaccggaaaucgccacccgccccaaagugcgcgaccaagaagcucguaugaacuacuacuggacucucgucgaacccggcgacaaaaucaccuucgaagccacuggaaaccuagucguaccacguuacgccuucacaauggaacgaaacgccggauccggaaucaucaucuccgacacccccguacacgacugcaacaccacaugccaaaccccagaaggagcaaucaacacgucccuccccuuccaaaacauacacccaaucaccauaggaaaaugccccaaauacguaaagagcaccaaacugcggcucgcaacaggccugcgcaacguccccucaauccaaucacgaggccucuucggcgcuaucgccggcuuuaucgaaggaggguggaccggaauggucgacggcugguacggcuaccaccaccagaacgaacaaggauccggauacgccgcagaucuaaaaucaacccaaaacgcgaucgacaaaauaaccaacaaagucaacuccgucaucgaaaagaugaacacacaauucaccgcugucggcaaagaguucaaccaccucgaaaaacgcaucgaaaaccuuaacaagaaggucgacgacggcuuccucgacauauggaccuacaacgccgaacuucuagucuuacucgaaaacgaacgaacccucgacuaccacgacaguaacgucaaaaaccucuaugaaaaaguccgaaaccaacucaaaaauaacgcaaaagaaauaggcaacggaugcuucgaguucuaccacaagugcgacaauaccugcauggaaucagucaaaaacggaacuuacgacuaccccaaguacucagaagaagccaaacucaaccgagagaaaaucgacggcgucaagcucgaaucaacccgcauauaucaaauccucgcuaucuacucaaccguggcaucaucccuaguccuagucgucagccuuggcgcaaucucauuuuggaugugcagcaacggaucccuccaaugcaggaucugcaucuaa

SEQ ID NO: 215719 - RNA, 1701 nt, Artificial Sequence
  derived and/or modified sequence opt from Influenza A H1N1 hemagglutinin
augaaagccauccucguaguacuucucuacaccuucgcaaccgcuaacgcagacacccucugcauaggguaccacgcgaacaacucaacagacaccgucgacacuguacucgagaaaaacgucaccguaacccacucagucaaccuacuagaagacaaacacaacggcaagcucugcaaacuccgcggcguagccccacuucaccucggcaaaugcaacaucgcuggcuggauccucggcaacccagaaugcgaaagucuaagcaccgccuccagcuggucauacaucguagaaaccuccagcuccgacaacggaaccugcuacccaggcgacuucauaaacuacgaggaacuccgggaacaacuuuccagcgucuccuccuucgaacgcuucgaaaucuucccaaaaacauccagcuggccaaaccacgacucaaacaaaggcguaaccgcagcaugcccccacgccggcgccaaaucguucuacaaaaaccucaucuggcucgucaagaaaggcaacagcuacccaaaacuaucccaauccuacauaaacgacaaaggcaaagaaguccuaguucuguggggaauacaccacccgucgaccaccgccgaccaacaaagccucuaccaaaacgcagacgccuacgucuucguaggcaccucccgcuacucaaagaaauucaaaccagaaaucgccauacgacccaaaguccgcgaccaagaaggccgaaugaacuauuacuggacacugguagaacccggagacaaaaucaccuucgaggccacaggaaaccuaguagugccacgcuacgccuucaccauggaacgaaacgccggcucaggcaucaucaucuccgacacccccguacacgacugcaacacuaccugccaaacgccugaaggugccaucaacacaucccucccauuccaaaacauacaccccaucaccaucggaaaaugcccgaaauacgucaaaagcaccaagcuacgccuagccacaggacuacgcaacgucccauccauacaaagccggggccucuucggcgccaucgccggcuucaucgaaggaggcuggaccggcauggucgacggcugguacggcuaccaccaccagaacgaacaaggcuccggcuacgccgccgaccucaaaagcacccaaaacgccauagacaaaauaacuaacaaagucaacagcgucaucgaaaagaugaacacucaauucaccgccgucgguaaagaauuuaaccaccucgaaaaacgcaucgaaaaccugaacaagaaagucgacgauggauucuuagacauauggacuuacaacgccgaauuacugguccuacuagaaaacgaacggacccuggacuaccacgacucuaacgucaaaaaccucuacgaaaaaguccgaaaccaacucaaaaacaacgccaaagaaaucggcaacggauguuucgaguucuaccacaaaugcgacaacacaugcauggaauccgucaaaaacggcaccuacgacuaccccaaauacucugaagaagcaaagcucaaccgagagaaaauagacggaguaaaacuggagagcacccgaauauaccaaauacucgcaaucuacagcaccguagcaagcagcgucguacuggucguaucacugggcgccaucuccuucuggaugugcucgaacggcagccuacagugcagaaucugcaucuaa

SEQ ID NO: 215720 - RNA, 1701 nt, Artificial Sequence
  derived and/or modified sequence opt from Influenza A H1N1 hemagglutinin
augaaggcaauucuaguaguacuguuauacaccuucgccaccgccaacgcugacacgcuaugcauaggcuaccacgcaaacaacucaaccgacacagucgacaccguccucgaaaagaacgucaccguaacacacagcgucaaccuccucgaagacaaacacaacgguaagcucugcaaacuacgcgguguagcaccccuccaccuuggcaaaugcaacaucgccggcuggauccuaggcaaccccgaaugugaaucacuaucuacagccuccuccuggagcuacaucgucgaaaccuccagcucagacaacggaacaugcuacccgggcgacuucaucaacuacgaagaacuccgagaacaacucucuuccguaagcucauucgaacgcuucgaaauauucccgaaaaccucaagcuggcccaaccaugaaucuaacaaaggcgucaccgccgcuugcccccaugccggcgcuaaauccuuuuacaaaaaccucaucuggcucgugaaaaagggcaacuccuaccccaaacucucacagucauacaucaacgacaaagggaaagaaguccuaguacucuggggcauccaccaccccagcacuaccgccgaccaacaaucgcucuaccaaaacgccgacgccuacgucuucguuggaaccucccgauacucuaagaaauucaaacccgaaauagcaauacgucccaaaguacgcgaccaggaaggacgcaugaacuacuacuggacacuugucgaacccggugacaaaauaacuuucgaagccacgggcaaucuagucgucccccgcuaugccuucacaauggaacgaaacgccggcuccggcauuaucauaucggacacaccaguacacgacugcaacacaaccugccaaacccccgaaggugccaucaauacuucccuccccuuccaaaacauccauccaaucaccauaggcaaaugccccaaauaugucaaauccacuaaacuccgccuggcaacaggccuacgcaacguccccucaauccaaagccgcggccucuucggcgcaauagccggcuucaucgaaggcggcuggacagggauggucgacggcugguacggauaccaccaccaaaaugaacaagggucaggcuacgcggcugaccuaaaaucaacccaaaacgccaucgacaaaaucacaaacaaaguaaacucaguuaucgagaaaaugaacacccaauucacugccguaggaaaagaguucaaccaccuagaaaaacgcaucgaaaaccucaacaagaaagucgaugacggcuuccucgacaucuggacauacaaugccgaacuacucguccuacuagaaaacgaacgcacccuagauuaccacgacuccaacgucaaaaaucuauacgaaaaaguccgaaaccagcucaagaacaacgccaaagaaauuggaaacggcugcuucgaguucuaucacaaaugcgacaauaccugcauggaauccgucaaaaacggcaccuaugacuauccaaaauacuccgaagaagccaaacuuaaccgcgagaaaauagacggcgucaaacuugaaagcacccgcaucuaccaaauccucgccaucuacuccacagucgccagcucaguaguucuagucgucucccuaggagcaaucuccuucuggaugugcagcaacggcucgcuccaaugcagaauaugcauauaa

SEQ ID NO: 215721 - RNA, 1701 nt, Artificial Sequence
  derived and/or modified sequence opt from Influenza A H1N1 hemagglutinin
augaaagcgaucuugguaguccuccuauacacauucgcgaccgcuaacgccgacacccucugcaucggcuaccacgcaaacaacuccacagacaccgucgacacaguccuagaaaagaacgucaccgucacccacagcguaaaccuccuagaagacaaacacaacggcaaacucugcaaacugagaggcgucgcaccccuacaccucggcaaaugcaacaucgcaggcuggauccuaggcaaccccgaaugcgaaucacuauccacggcgucaagcuggaguuacaucgucgaaacaucaucaagcgacaacggcacaugcuacccaggugacuucaucaacuacgaagaacuacgcgaacaacucuccuccguuucguccuucgaacgcuucgaaauauucccgaaaacguccuccuggcccaaccacgaaucaaacaaaggcgucacagcugcauguccccacgcaggagcaaaaucuuucuacaaaaaccugaucuggcuagucaaaaagggaaacuccuacccgaaacuaucccaaucauacauaaacgacaaaggcaaagaaguccuaguucuauggggaauccaccacccgcccaccacagccgaccaacagucacuauaccaaaacgccgacgccuacguauucgucgggacaucacgauacagcaaaaaguucaagcccgaaaucgcgauccgacccaaaguacgagaccaagaaggccgaaugaacuacuacuggacccucguagaacccggcgacaaaauaaccuucgaagcaaccggcaaccucgucgugccgcgcuacgccuucaccauggaacgcaacgcaggcucaggaaucaucaucucagacacacccguacacgacugcaauacaaccugccaaaccccagaaggagccauuaacacaucccuccccuuccaaaacauacacccaauaacaaucggaaagugcccaaaauacgucaaauccacaaaacuccgccucgcaacaggacuacgcaacgucccguccauacaaagccguggccucuucggcgcaaucgcaggcuucaucgaaggcggcuggacaggaauggucgacgggugguacggguaccaccaccaaaacgaacaaggcuccggcuacgccgccgaccuaaaauccacgcaaaacgccauagacaaaauaaccaacaaagucaacuccguaaucgaaaagaugaacacccaauucaccgcaguagggaaagaguucaaccaccuggagaaaagaaucgaaaaccuaaacaagaaagucgaugacggcuuccuugacaucuggacauacaacgccgaacuccugguacuacucgaaaacgaaagaacacucgacuaccacgacucaaacguaaagaaccuguacgaaaaaguacgaaaccaacugaaaaacaacgcaaaagaaaucggaaacggcugcuucgaguucuaccacaaaugcgacaauaccugcauggaauccgucaaaaacggcaccuaugacuaccccaaauauuccgaagaagcaaaacucaacagagagaaaauagacggcgucaaacuugaaagcacaagaauauaccagauccuagccauauacuccacagucgccucuagcgucguccuagucgucagccucggcgcaaucuccuucuggaugugcuccaacggcucccuccaaugccgcauaugcaucuag

SEQ ID NO: 215722 - RNA, 1701 nt, Artificial Sequence
  derived and/or modified sequence opt from Influenza A H1N1 hemagglutinin
augaaagcuauaauaguuguacuccucuacacauucgccaccgcggaugcagacacacuuugcaucggcuaccacgccaacaacucaaccgacacaguugacaccguacuugagaaaaacgugaccgucacacacagcguaaacauucuugaaaacaaacacgacggcaaacucugcaaacuccgcggcgucgcaccccuucaccuaggcaagugcaacaucgccggauggcuacucggaaaccccgaaugcgaaucacuguucgccgccucaagcugguccuacaucguagaaacgcccaacuccgacaacggaacuugcuaccccggagacuucaucaacuacgaagaacuaagagaacaccuuucaagcguuuccucauucgaacgcuucgaaauauuccccaaagcaaacucauggcccaaccacgauacaaacaaaggagucaccgcagccugccccuaugcaggcgcaaacagcuucuaccgcaaccuaaucuggcucguaaagaaagggaacuccuacccaaaacuauccaaaucauacauaaacaacaaaaagaaagaaguccuaguaaucuggggcauacaccacccgcccaccuccauagaccagcaaacacuuuaccaaaacgccgacgccuacguauucguaggcuccuccaaauacuccaaacgauucaaaccggaaaucgcggccagaccgaaagugagagaccaagccggccgcauggacuacuacuggacucucaucgaacccggcgauaccauaaccuucgaagcaacaggcaaccuugucgugcccagauaugcguucgccaugaaacgcggaagcggcagcgggaucaucguauccgacgcccccguccacgacugcaacaccacaugccaaacaccgaaaggagccauaaacacaucacuacccuuccaaaacauccaccccgucaccauaggcgagugccccaaauauguaaaaucuacgaagcuacgaauggccaccggacuccgcaacaucccaucaauccaauccagaggccuauucggcgccaucgccggcuuuauagagggcggguggaccggcaugauagacggcugguacggauaccaccaccaaaacgaacaaggaagcgguuacgcagccgaccagaaaagcacccaaaacgccaucgacgggaucaccaacaaagucaacagcaucaucgagaaaaugaacacccaauucacagcagucggcaaagaguucagccaacucgaaaaacgcauagaaucacucaauaacaaagucgacgacggcuuccuagauaucuggacauacaacgccgaacuccuaguccugcuggaaaacgagcgaacccucgacuaccacgauucgaacgucaaaaaccuauacgaaaaaguucgcucccaacucaaaaacaacgccaaagaaaucggaaacggcuguuucgaguucuaccacaaaugcgacaacacgugcauggaauccgucaaaaacggcaccuaugacuacccuaaauacucagaagaagccaaacucaaccgagaagaaaucgacgggauuaaacucgaauccgccagaauauaccaaauccuagccaucuacuccacaguagccagcucucugguacucuuggucucccucggcgccguaucauucuggaugugcuccaacggaucccuacaaugcagaauaugcaucuag

SEQ ID NO: 215723 - RNA, 1701 nt, Artificial Sequence
  derived and/or modified sequence opt from Influenza A H1N1 hemagglutinin
augaaagcaauacuacucguccuacucuacacauucaccgccgcaaacgcggacacccuaugcauuggcuaccacgccaacaacuccaccgacaccguagacacaguucucgagaaaaacgugaccgucacucacagcguaaaccugcucgaggacagacacaacggcaaacucugcaagcuccgaggcgucgcaccucuccaccuaggcaaaugcaacauagcagguuggcuacugggcaaccccgagugcgaacuacuguucaccgccuccucauggagcuacaucguagaaaccaguaacagcgacaacggcacaugcuacccaggagauuucauaaacuacgaagaacucagagagcaacucucauccguaagcucauucgaacgauucgaaauauuccccaaggcgagcucauggcccaaccacgaaacaaaccgcggcgugacagccgcaugccccuacgccggggccaacuccuucuaccggaaccuaaucuggcuagucaagaaaggcaacagcuaccccaaacucuccaaauccuacguaaacaacaaagaaaaagaaguccuaguacuuuggggaauccaccacccgcccacaagcacagaccagcaaucgcuauaccagaacgccgacgccuacgucuucgucggaagcuccaaauacaacaagaaauucaaaccagaaaucgcaacacgccccaaagugcgaggacaagccggcagaaugaacuacuacuggacacucgucgaaccgggagacaccaucacuuucgaagcgacagggaaccuugucguaccccgcuacgcauucgccaugaaacgcggauccggaagcggaaucauaaucucagacacccccguacacgacugcaacaccacaugccaaaccccaaaaggagccaucaacaccagccugccuuuccaaaacauccacccaguaaccaucggcgaaugccccaaauacgucaaaucaacaaaacuaagaauggcaacaggucuacgcaauaucccgagcauacaaagccgcggccuauuuggagccaucgcgggcuucauagagggcggcuggacaggcaugaucgacggaugguacggauaccaccaccaaaacgagcaaggcagcggguacgcagcggaccguaaaagcacccaaaacgccauugacggcaucacaaacaaagucaacagcgucaucgagaaaaugaacacacaauucaccgcggucggcaaagaguucaaccaccuggaaaaacgcauagaaaaccuaaacaagaaagucgacgacggcuuucuggacguauggaccuacaacgccgagcuccucguucugcucgaaaacgagcgcacgcucgacuaccacgacuccaacgucaaaaaucucuacgaaaaaguccgaagccaacucaaaaacaacgccaaagaaauagguaacggcugcuucgaguucuaccacaaaugcgacgacacaugcauggaaucagucaaaaacggcaccuacgacuacccaaaauacuccgaagaauccaagcuaaaccgcgaagaaaucgacggcgucaaacucgaauccacccgaauauaccaaauacuagccaucuacuccaccguggcaagcucccuaguucuccuaguaagccuaggcgcgaucagcuucuggaugugcuccaacgguucccuucaaugccggauaugcaucuaa

SEQ ID NO: 215724 - RNA, 1701 nt, Artificial Sequence
  derived and/or modified sequence opt from Influenza A H1N1 hemagglutinin
augaaagccauaaucgucguacuacuccacacguucgcaaccgcagacgcggacacccucugcaucggcuaccaugcuaacaacucaacagauacagucgacaccguccucgagaaaaacgucaccgucacccauagcguaaaccuccuagaaacaaaacacgacggcaaacuauguaaccucaaaggagucgcuccccugcaccucggcaaaugcaacaucgccggauggcuucucggcaacccagaaugcgaaucccuauucaccgccuccucuugguccuacauugucgaaacaccaaacagcgacaacggaaccuguuacccaggcaacuucauaaacuacgaagaacuacgcgaacaccucuccagcgucucauccuucgaacgauucgagauauuccccaaagccaacagcuggccaaaccacgacaccaacaaaggugucaccgcagccugucccuacgccggagccaacuccuucuacagaaaccucaucuggcucgugaagaaaggcaacucauaccccaaacucucaaaauccuacaucaacaacaaaaagaaagaaguccucgucauauggggaauccaucacccacccaccuccaccgaccaacaaacacuauaccagaacgccgacgccuacgucuucguaggcucgucaaaauacagcaaacgcuuugagcccgagaucgccgcccgucccaaaguacgcaaccaagcaggaaggaugaacuacuacuggacgcucaucgaaccaggagacacaaucaccuucgaagccacaggcaaccucgucgucccccgcuacgccuucgcaaugcggcgagggucaggaagcggcaucaucgucuccgacgccccaguccaugacuguaacaccacgugccaaacacccaaaggagccaucaacacgagucuccccuuccaaaauauucaccccgugacaaucggcgaaugcccaaaauacgucaaaagcacaaaacuccgcauggccacgggccugcgcaacaucccauccauccaaucccgaggccucuucggagccaucgcaggauuccuagaagguggauggacaggcaugaucgauggcugguacggauaccaccaccaaaacgaacaaggaagcggauacgccgccgaccaaaaaucaacccaaaacgccaucgacggcaucaccaacaaaguaaacuccaucaucgaaaagaugaacacccaauucaccgccgucggcaaagaguucucccaacucgaaaaacgcauagaaucacucaacaacaaggucgacgacggauuccuagacaucuggacauacaacgccgagaugcugguccuccucgaaaacgaacgcacacuggacuaccaugacucaaacgucaaaaaccucuacgaaaaaguaagaucccaacucaaaaacaacgccaaagaaaucggcaacggcugcuucgaauuuuaccacaaaugcgacaacacaugcauggaauccgucaagaacggaacuuacgacuaccccaaauauagcgaagaggccaaacucaaccgcgaagaaaucgacggagucaaacucgaguccgcacgaaucuaucaaauccuagccaucuacuccaccgucgcauccucccucguacuccuagucucccuaggcgccguauccuucuggaugugcuccaacggaagucuccaaugccgaaucugcauauag

SEQ ID NO: 215725 - RNA, 1701 nt, Artificial Sequence
  derived and/or modified sequence opt from Influenza A H1N1 hemagglutinin
augaaagcaauccuaguuguccuacuauacacguucgcaaccgcaaacgccgacacccuaugcauaggauaccacgccaacaacucaaccgacaccguugacaccguccucgagaaaaacguaaccguaacccacucaguaaaccugcuggaagacaaacacaacggaaaacucugcaaacuacgaggcgucgcaccccuacaccucggaaaaugcaacaucgccggauggauccugggcaaccccgaaugcgaaucacuauccaccgccuccucauggagcuacaucgucgaaacaagcuccuccgacaacgguacgugcuacccaggcgacuucauagacuacgaagaacugcgagaacaacucagcuccgucagcucauucgaacgcuucgaaauauucccgaagacgucgucauggcccaaccacgacuccaacaaaggcguaaccgccgccugcccacacgccggcgcaaaguccuucuacaaaaaccucaucuggcucgugaagaaaggcaacucuuaccccaaacugucaaaaucauacaucaacgacaagggcaaggaaguucucguacucuggggaauacaccauccaagcaccuccgccgaccaacagagccucuaccaaaacgccgaugccuacguguucgucggcagcucacgcuacucaaagaaauucaaaccagaaaucgccauucgaccgaaaguccgcgaccaagaaggccgaaugaacuacuacuggacccuaguagagcccggagacaaaaucacauucgaagcgacaggcaaccucgucguaccacgcuacgcguucgccauggagagaaacgccggaucaggaauaauaaucucagacacgccuguccacgacugcaacaccacaugccaaaccccaaaaggcgcaauaaacaccucgcuacccuuccaaaauauccaccccaucaccauaggcaaaugccccaaauacgucaaaagcaccaaacuacgccuggcaaccggccucagaaacguacccuccauccaaucacgcggauuauucggugcaaucgcgggauucaucgaaggaggcuggaccggaauggucgacggcugguacggauaccaccaucagaaugaacaaggcuccggauacgccgccgaccucaaauccacccaaaacgccaucgacgaaaucaccaacaaagucaacagcgugaucgagaaaaugaacacacaauucacggccguaggcaaagaguucaaccaccucgaaaaacgcauagaaaaccuuaacaagaaagucgacgacggauuccucgacauauggaccuacaacgccgaacuccucguacuccucgaaaacgaacgcacccuugacuaccacgacagcaacgucaaaaaccucuacgaaaaaguccgcucacaacucaaaaauaacgcgaaagaaauaggcaacggcugcuucgaguucuaccacaaaugugacaauaccugcauggaaagcgucaaaaacgggaccuaugacuaccccaaauacucagaagaagcaaaacuaaaccgcgaagaaaucgacggagucaaacucgaauccacccgaaucuaccaaauccuagccauauacagcaccguagcauccagccucguccucgucgucucgcucggcgcaaucagcuucuggaugugcagcaacggaucacuacaaugccgcauaugcauauaa

SEQ ID NO: 215726 - RNA, 1701 nt, Artificial Sequence
  derived and/or modified sequence opt from Influenza A H1N1 hemagglutinin
augaaagccauccuagucguacuucuuuacacauucgcaaccgccaacgccgacacacucugcauaggguaccacgccaacaacuccaccgacaccguagacaccguccucgagaaaaacgucaccgucacacacagcgucaaccuccuagaagauaaacacaacggaaaacucugcaagcugcggggcgucgcaccccuccaccucggcaaauguaacaucgccggcuggauccucgguaaccccgaaugcgaaucccuuuccaccgccucaucuugguccuacaucguagaaaccagcuccucagacaaugggaccugcuacccaggcgacuucauagacuacgaagaacugcgcgaacaacuauccagcgucuccucauucgaacgauucgaaaucuucccaaaaacaucaucguggcccaaccacgacagcaacaaaggcgucaccgccgccugcccacaugccggcgcaaaaucuuucuacaaaaaccucauauggcucgucaagaaaggcaacagcuaccccaaacugagcaagagcuacauaaacgauaagggcaaagagguccuaguccuauggggaauccaccaccccuccaccuccgcagaccaacagucucucuaccagaacgccgacgccuaugucuucguaggauccucccgauauuccaagaaauucaaaccagaaauagccauccgcccaaaaguaagaggacaagaaggccgaaugaacuacuacuggacccuagucgaacccggcgacaaaauaaccuucgaagcaaccggaaaccugguaguaccccgcuacgccuucgccauggagcgaaaugccggcagugggaucaucaucucagacacccccguccacgacugcaacacgaccugccaaacacccaaaggagcaaucaauaccagccuaccauuccaaaacauucauccaaucaccaucggcaagugccccaaauacgucaaaucaaccaagcucagacucgccaccggccuccgcaacguccccagcauacagucccgcgggcuguucggcgccaucgcgggauucaucgagggcggauggaccggcaugguagauggcugguacggcuaccaccaccaaaacgaacaaggcagcgguuacgcagcagaccuaaaauccacccaaaacgccauagacgaaauaacaaacaaagucaacuccguuaucgagaaaaugaacacgcaauucaccgccgucggaaaagaguucaaccaccucgaaaaacguaucgaaaaccucaacaagaaagucgacgacggcuuccucgacaucuggaccuacaacgccgaacuccucguccuacucgaaaacgaacgaacccucgacuaccacgacuccaacgucaaaaaccucuacgaaaaaguccgaucccaacucaagaacaacgcaaaagaaaucggcaauggcugcuucgaguucuaccacaagugcgacaacacaugcauggaauccgucaaaaacggcaccuacgacuaccccaaauacagcgaagaagccaaacuaaaccgggaagaaauagacggaguaaaacuagaaucaacccgcauuuaccaaauccucgccauauacuccacagucgccuccagccuaguauuagucguaucacucggagccaucucauucuggaugugcucgaacggcagccuacaaugccggaucugcaucuaa

SEQ ID NO: 215727 - RNA, 1701 nt, Artificial Sequence
  derived and/or modified sequence opt from Influenza A H1N1 hemagglutinin
augaaagcaauccuggucguccuacuauacaccuucgccaccgcaaacgccgacacccucugcauuggcuaccacgccaacaacuccaccgacacagucgacaccguccucgaaaagaacgucacaguaacacacuccgucaaccuacucgaagacaaacacaacggcaaacucugcaaacuccgcggaguagcaccccuacaccuaggcaaaugcaacaucgccggcuggauccucggcaaccccgaaugcgaaucgcuaagcacggcuucauccugguccuacauagucgaaaccagcuccuccgacaacggaaccugcuaccccggugacuucauagacuacgaggaacucagggaacaacuaagcucagucucuuccuucgaacgcuucgaaaucuucccaaaaacauccuccuggccaaaccacgacuccaacaaaggaguaacggccgccugcccccacgccggcgcaaaauccuucuauaaaaaccuaaucuggcuagucaagaaaggaaacagcuacccgaaacucuccaaaucauacauaaacgacaaaggaaaagaaguccuaguccuauggggcauacaccaccccagcaccuccgccgaccaacaaagccucuaccaaaacgccgacgccuauguauucgucggauccucacgauacagcaaaaaguucaaaccagaaaucgccauccggcccaaaguccgcgacagagaaggacgcaugaacuacuacuggacccucgucgaaccaggcgacaaaauaacauucgaagcaaccggcaaccuagucgucccccgcuacgcauucgcgauggaacgcaacgcgggcucagggauaaucauaucugacacaccgguccacgauugcaacacaacaugccaaacccccaaaggcgccauaaacaccagccuccccuuccaaaacauccaccccaucaccaucggaaaaugccccaaauacgucaaauccacaaaacuccgccucgccaccggccucagaaacguacccaguauccaaucccgcggccucuucggggcaauagcagguuucaucgaaggaggcuggacagguauggucgacggcugguacggauaccaccaucaaaacgaacaaggcucgggcuacgcggccgaucucaaauccacccagaacgccaucgacgaaaucacaaacaaagucaacuccguaaucgagaaaaugaacacccaauucaccgccgucggaaaagaguucaaccaccucgaaaaacgaaucgaaaaccucaacaagaaaguagacgacggguuccucgacauauggacauacaacgcagaacuccucguccuccucgaaaacgaacgaacccucgacuaccacgacucgaacgucaaaaaccuauacgaaaaaguacgaagccaacucaaaaacaacgcuaaagaaaucggaaacggaugcuucgaguucuaccacaagugugacaacacaugcauggaauccgucaaaaacggcacauaugacuaccccaaauacucugaagaagccaagcuaaaccgcgaagaaaucgacggcguaaagcuagaaucgacacgcauauaccaaauccucgccaucuacuccaccguagcaucaucccugguacuggucgucucccuaggcgcaaucucauucuggaugugcuccaacggcucccuucaaugccggauaugcaucuaa

SEQ ID NO: 215728 - RNA, 1701 nt, Artificial Sequence
  derived and/or modified sequence opt from Influenza A H1N1 hemagglutinin
augaagacaaucauagccuuauccuacauacucugccuugucuucgcgcaaaaacuccccggcaacgacaacagcaccgcaacccucugccuaggacaucaugccguacccaaugggacaaucgucaaaacgauaacaaacgaccgcaucgaagucaccaacgccaccgagcuaguccaaaacuccucuauaggagaaaucugcgacuccccacaccaaauacuagacggcgaaaacuguacccucauagacgcccuccugggagacccacaaugcgacggauuccaaaacaagaaaugggaccuguucgucgaacgaagcaaggcauacagcaacugcuaccccuacgacgucccugacuacgcaagccuccgcucccuaguugccuccagcggcacucuggaguucaacaacgaauccuucaacuggaacggcgucacacaaaacgggaccucaagcgccugcauccgccgcuccaauaacagcuucuucucccgcuuaaauuggcucacucaccucaacuucaaauacccagcccucaacguaacaaugccuaacaacgaacaauucgacaaacucuacaucuggggaguccaucaccccgggaccgacaaagaccaaaucuuccucuacgcacaacccuccggccgaaucacagucucaaccaaaagaucccaacaagccgucauccccaacaucggaucacgaccccgaaucaggaacauacccagccgcaucucaaucuacuggacaauagucaagcccggagacauacuucugaucaacuccaccggcaaucuuauagccccacgaggauacuucaagauccgaucaggcaaauccucaauaaugcgcuccgacgcgccaauaggcaaaugcaaaagcgaaugcaucacacccaacggcagcauccccaacgacaaaccguuccaaaaugucaaccgcauaacauacggggccugcccccgcuacgucaaacaaagcacccuaaaacucgcaaccggcaugcgcaacguccccgaaaaacaaacccgcgggauauucggcgccaucgccggcuucauagaaaacgggugggaaggcaugguagacggcugguacggcuucagacaccagaacagcgaaggacgcggccaagcagccgaccuaaaaagcacccaagccgcaaucgaccagauaaacgguaaacucaaccgccuaaucggaaaaaccaaugaaaaguuccaccaaaucgaaaaagaguucuccgaagucgaagggcgaauccaagaccucgaaaaauauguggaagacacaaaaauagaccuauggucauacaacgcagaacugcucgucgcacuagaaaaccaacacacgauugaccucaccgacucggaaaugaacaaacucuucgagaaaacaaagaaacaacuccgcgaaaacgccgaagacaugggaaacggcugcuucaaaaucuaccacaaaugcgacaacgccugcaucggaucgaucagaaacggcaccuacgaccacgacguuuaccgcgacgaagcccuaaacaaucgcuuccaaaucaaaggcguagaauuaaaauccggauacaaagauuggauccucuggaucucauucgccauauccuguuuccuacucugcguagcccuccucggauucauaaugugggccugccaaaaagggaacauccgcugcaacauaugcaucuaa

SEQ ID NO: 215729 - RNA, 1701 nt, Artificial Sequence
  derived and/or modified sequence opt from Influenza A H1N1 hemagglutinin
augaaagcaauccuaguugugcuccucuacacauucaccacggccacagcagacacccuuugcaucggcuaccacgcaaacaacuccaccgacaccgucgacacaguccucgagaaaaacgucacagucacccacuccgucaaccuacuugaaaaccggcauaacgggaaacucugcaaacuacgaggagucgcaccccuccaccucggcaaaugcaacauagccgguuggcuacuaggaaaucccgaaugcgaaucccuaucaacugccuccucuugguccuacaucgucgaaaccagcaacuccgacaacggcacauguuaccccggggacuucaucaacuacgaggaacuccgcgaacaacuuuccagcgugucuuccuucgaacgcuucgaaaucuucccaaagacuagcagcuggccgaaccacgacacaaaccgcggugucacagccgcaugcccccacgacggaaccaacagcuucuaccgaaaccucaucuggcucgucaagaaaggcaacucuuaccccaaaauaaacaagucauacauaaacaacaaagagaaagaaauccucguucuaugggcaauccaccaccccagcaccuccgccgaccagcagucucucuaccaaaacgcugacgcauacgucuucgucggaucuucacgcuacagccgaaaauucgaacccgaagucgccacucgccccaagguccgcgaccaagcgggcaggaugaacuacuacuggacccucgucgaaccaggcgacaaaauaacauucgaagccaccggcaaccuagucgugccuagauacgccuucgcccuuaagcgcaacuccggauccgguaucauaaucuccgacacguccguccacgacugcgacacaaauugccaaacccccaacggggccauaaacacaucccucccauuccaaaacauacaccccgucacaaucggagagugccccaaauacgucaaaucgacaaaacugcgaauggcaaccggccuacgaaacauccccuccauacaaagccgcggccucuucggcgcgauagcaggcuucaucgaaggaggauggacaggaaugaucgacggcugguacggauaccaccaccaaaacgagcagggauccgguuacgcagcagaccucaaguccacccaaaacgccaucgacggaaucacgaacaaaguaaauucagucaucgagaaaaugaacacacaauucacagccguuggaaaagaguucucccaccuagaacgucgaaucgaaaaccucaacaagaaagucgacgacggauuccucgacauauggaccuacaacgccgaacuccucguccuacuugaaaacgaacgaacccucgacuaccacgacuccaacgucaaaaaccucuacgaaaaaguccgaucacaacucaaaaacaacgccaaagaaaucgguaacggcugcuucgaguucuaccacaaaugcgacgacauguguauggaaagcgucaaaaacggcaccuacgacuacccaaaauacuccgaagaagccaaacucaaccgcgaagaaaucgacggaguaaaacucgaauccacacgaaucuaccaaauccuggccaucuacuccaccguagccucgucccucguccuaguaguaagccucggcgccaucuccuucuggaugugcuccaacgguagccugcaaugccgcaucugcauauga

SEQ ID NO: 215730 - RNA, 1689 nt, Artificial Sequence
  derived and/or modified sequence opt from Influenza A H2N2 hemagglutinin
auggccauuauauaccucauacuccuguucaccgccguccgaggcgaccaaaucugcaucggauaccacgcaaauaacuccacagaaaaggucgacaccauacucgaacgcaacguuacggucacacacgcaaaagacauacucgagaaaacccacaacggaaaauuaugcaaacuaaacggcaucccaccacucgaacucggcgacugcagcaucgcaggcuggcugcuaggaaaccccgaaugcgaccgacucuuaagcguacccgaauggucuuacauaauggaaaaagagaacccccgugacgggcuaugcuaccccggcagcuucaacgacuacgaagaacucaaacaccuccucagcucaguuaaacacuucgaaaaagucaagauccuccccaaagaccgcuggacgcaacacaccacaacaggaggaucccgcgccugcgccgucuccggcaacccaucauucuuuagaaacaugguauggcugaccgagaaagggagcaacuacccaguagcaaaaggaucauacaacaauaccagcggcgaacaaaugcuaauaauauggggcguccaccaccccaacgacgaaaccgaacagagaacgcuguaccagaacgugggcaccuacguaagugucgggacaagcacccuaaacaaaagaagcacacccgaaauagcaacacgaccaaagguaaacggucaaggcggacgaauggaguucuccuggacacuacucgacaugugggacacaauaaacuucgaauccacaggcaaccuaauagcgccggaauacggcuucaaaauaagcaagcgcggaagcucgggcauaaugaaaacagaaggcacacucgaaaacugcgaaacaaaaugccaaacaccccuaggcgccauaaacaccacccugccauuucacaacguacacccacuaaccaucggcgaaugcccaaaauacguaaagucagaaaaacucgugcucgcaaccggauuaaggaacgucccacaaaucgaaagcagaggacucuucggcgccauagccggauucauagaaggaggcuggcaaggcaugguagacgggugguacggcuaccaccacagcaacgaccagggcagcggauacgcggccgacaaagaauccacacaaaaagccuucgacggcauaaccaacaaagugaacuccgucauagagaaaaugaacacgcaguucgaagccgucggcaaagaguucagcaaccuagaacgaagacuggaaaaccuaaacaagaaaauggaagacggcuuccucgacguauggaccuacaacgcagaacuccucguacucauggaaaacgaacggacacuagacuuccacgacagcaacgucaaaaaccuguacgacaaaguaagaaugcaacugagagacaacguaaaagaacucggaaacgggugcuucgaguucuaccauaaaugcgacgacgaaugcaugaacagcgugaagaacggcaccuacgacuaccccaaauaugaagaagaaagcaaacucaaccgcaacgaaauaaaaggcgugaaacucagcuccaugggagucuaccaaauacuagcaaucuacgccacagucgccggaucacucagccuagcgaucaugauggccggcaucagcuucuggaugugcucgaacggcagccuccaaugucgcauaugcauauaa

SEQ ID NO: 215731 - RNA, 1701 nt, Artificial Sequence
  derived and/or modified sequence opt from Influenza A H3N2 hemagglutinin
augaaaacgaucaucgcacucuccuauauauucugccucgcccucggacaagaccuacccgguaacgauaacagcacagccacacuaugccucggacaccacgccguccccaacggcacccuaguaaaaacaaucacagacgaucaaaucgaaguaaccaacgccaccgaacugguccaaagcucaaguacaggaaaaauaugcaacaacccccaucgaauccucgacggaauagacuguacccucaucgacgcguugcucggcgacccccacugugacgucuuccagaacgaaaccugggaccuauuuguagaacgcucaaaagcauucuccaacugcuaccccuacgacgugccugacuacgccucccuacguucccuugucgccuccagugggacccuagaguucaucacugaaggauucaccuggacgggcgugacccaaaauggaggcagcaacgcaugcaaacguggucccggauccggauucuucagucgucucaacuggcugacgaaaucaggcuccaccuacccuguccugaacguaaccaugcccaacaacgacaacuucgacaaacuuuacaucuggggcguacaccacccauccacuaaucaagaacaaacgagccuguacguccaagcaagcggccguguaaccgucagcacccgccgcagccagcaaacuaucauccccaacaucgaaagccgacccuggguccgaggacuauccucacgcauaucuaucuacuggacaaucgucaaacccggagacguccuagucaucaacagcaacggcaaccucaucgcaccccgcggauacuucaaaaugcgcacaggcaaguccuccaucaugcgcuccgacgcccccauagacacgugcaucuccgaaugcaucacacccaacgggagcauccccaacgacaaacccuuccaaaaugucaacaaaauaaccuacggcgcaugccccaaauacgucaaacaaaacacccucaaacuagccaccggcaugcgaaacgucccggaaaaacaaacccgcggccuuuucggcgcaauagccgguuucaucgagaacggcugggaaggcaugaucgacggcugguauggcuuccgccaccaaaauucagaaggaaccggacaagcagccgaccucaaaagcacacaagccgcaaucgaccaaauuaauggcaaacuuaaccgaguaaucgaaaagacaaacgaaaaauuccaucagaucgaaaaagaguucucggaaguagaaggcagaauccaagaccucgaaaaauacgucgaagacaccaaaaucgaccucuggucauacaacgcggaacuccucgucgcacuagaaaaccagcacacaaucgaccugaccgacagcgaaaugaacaaacucuucgaaaagacgcgucgacaacuacgagaaaacgccgaagacaugggcaacggcugcuucaaaaucuaccacaaaugcgauaacgcgugcaucgaaucgaucagaaacggcaccuacgaccacgacguguaccgcgacgaagccuuaaacaaucgauuccaaaucaaaggcgucgagcucaaaagcggauacaaggacuggauccuauggaucagcuuugccauaagcugcuuccuucucugcgucguacuccucggauucaucaugugggccugccaacgaggcaacauacgcugcaacaucugcaucuaa

SEQ ID NO: 215732 - RNA, 1701 nt, Artificial Sequence
  derived and/or modified sequence opt from Influenza A H3N2 hemagglutinin
augaaaaccauaaucgcccucagcuacauacuaugccuggucuucgcacaaaaacuccccggcaacgacaacagcacagcaacccucugccucgggcaccacgcgguaccaaacggcaccauaguaaaaaccaucaccaacgaccgcaucgaggucacaaacgccaccgaacucguacaaaacagcuccaucggcgaaauaugcgacuccccacaccaaauacuugacggcgaaaacugcacacucaucgacgcacuccucggcgacccacaaugugacggguuccaaaacaaaaagugggaccuuuuuguugaacgauccaaagcauacuccaacuguuacccuuacgacguccccgacuacgccucauuacgcagccucgucgcaucaucaggcacacuagaguucaacaacgaaucguucaacugggccggcguaacccaaaauggcaccucauccgccugcaaacgcggcuccaauuccucauucuuuagccgccugaacuggcucacacaccugaacuucaaauauccagcccuaaacguaacaaugcccaacaacgaacaauucgacaaacuauacaucuggggcguacaccaccccgucaccgacaaggaccaaaucuuccucuacgcccaguccagcgggcgcauaaccgugagcaccaaacguucccagcaagcagucauacccaacauaggcuuccgacccagaauccgaaacauccccucacgcaucucuaucuacuggaccauaguaaagcccggcgacauccuccugauaaacuccaccgggaaccucaucgcgccccgcggguacuucaaaauccgcuccggaaaaucaagcaucaugcgaagcgacgcccccauagguaaaugcaaauccgaaugcauaacacccaacggcuccauccccaacgacaaacccuuccaaaacguaaaucgaauaaccuacggcgcaugcccgcgcuacguaaagcaauccacacucaaacuugccacaggaaugcgcaacgucccagaaaaacaaacacgcgggauauucggcgccaucgcaggcuuuauagaaaacggaugggaaggcauggucgacggcugguacggauuccgccaccagaacuucgaaggacgcggacaggcagccgaccucaaaagcacccaggccgcaauagaccaaaucaacggcaaacucaaccgacugaucggcaaaacuaacgaaaaauuccaccaaaucgaaaaggaguucuccgaaguagaaggcagaauacaagaccuagaaaaauacgucgaagacacgaaaaucgaccuaugguccuacaacgccgaacuccucgucgcccuagaaaaccaacacacaaucgaccucaccgacucagaaaugaacaaacucuucgagaaaacuaagaaacagcuacgcgaaaacgccgaagacaugggcaacggaugcuucaaaauauaccacaaaugcgacaacgccugcaucggguccauucgaaacgggacauacgaucacgacgucuacagagacgaagcccucaacaaccgcuuccaaauuaaaggagucgaacuuaaaucaggcuacaaagacuggauacuauggauauccuucgccaucuccugcuuccuccucugcgucgcacugcuggguuucauaaugugggcaugccaaaaaggaaacauccgcugcaacauaugcaucuga

SEQ ID NO: 215733 - RNA, 1701 nt, Artificial Sequence
  derived and/or modified sequence opt from Influenza A H3N2 hemagglutinin
augaaaacaauaaucgcccuuucuuacauacucugccucgucuucgcccaaaaacuuccaggcaacgacaacagcacagccacacuaugccucggccaccaugccguccccaacggcaccaucguuaaaaccaucaccaacgaccgcaucgaggucaccaacgccacagaacucguccaaaacuccuccaucggcgaaaucugcgacucaccccaccaaauacucgacggcgaaaacugcacccuaaucgacgcccuacuaggcgacccccaaugcgacggauuccagaacaagaaaugggaccucuucguagaacgauccaaagccuacagcaacugcuacccauaugacguacccgauuacgcaucccuccgaucacucguagcauccagcggaacucucgaguucaacaacgaauccuucaacugggcaggcgucacccaaaacggaaccagcagugcaugcauccgcggcuccaacuccagcuucuucucaaggcuaaacuggcucacccaccuaaacuucaaauaccccgcccugaacgucaccaugcccaacaacgaacaguucgacaaacucuacaucuggggaguccaccaccccggcaccgacaaagaccagaucuuccuguacgcccaauccuccggccgcauaaccgucucgacaaaacgaucccaacaagccgucauacccaauaucgggucccgcccccgcaucagaaacauacccucacgcaucuccauauacuggaccaucguaaaacccggcgacauccuccucaucaacaguacaggcaaucucauagcaccccgcggguacuuuaaaauacgcucaggcaaaagcuccaucaugcgaucagacgccccaaucggcaaaugcaaaagcgaaugcauaacucccaauggcagcauaccaaacgacaaacccuuccaaaacgucaacagaauaaccuauggcgcuugcccacgcuacgucaaacaauccacacucaaacucgccaccggcaugcgcaacguacccgaaaaacagacccgcggaaucuucggugccauagccggauucaucgaaaacggaugggaaggcauggucgacggaugguacggcuuccgacaccaaaacuucgaaggacgcggacaagccgccgaccuaaaauccacacaagcggccaucgaccaaauaaacggcaaacuaaaccgccuaaucggcaaaaccaacgaaaaauuccaccagauagagaaagaguucucagaagucgaaggacgcauccaagaccuagagaaauacgucgaagacacaaaaauagaccucuggucguacaacgccgagcuccucgucgcacuagaaaaccaacacacuaucgaccucacagauucagaaaugaacaaacuauucgagaagaccaagaaacagcuccgcgagaacgccgaggacauggguaacgggugcuucaaaauuuaccacaaaugcgacaacgccugcauaggcuccaucaggaacggcaccuacgaccacgacguauacagggacgaagcccucaacaaccgcuuccaaaucaaaggcgucgaacuaaaaagcggcuacaaagacuggauccucuggaucagcuucgcaauauccugcuuccuccuaugcguagcacuccucggcuucaucaugugggccugccaaaaaggaaacauccgauguaacaucugcaucuaa

SEQ ID NO: 215734 - RNA, 1701 nt, Artificial Sequence
  derived and/or modified sequence opt from Influenza A H3N2 hemagglutinin
augaaaacaaucaucgcacugucauacauacuaugccucguguucgcccaaaaacucccaggcaacgacaacagcacagccacccucugccuaggccaccacgccguccccaacggcaccaucgucaaaaccaucaccaaugaccgcauugaagucacaaacgccacagaacucguacagaacuccagcauuggcgaaauuugugacuccccacaucaaauacuagacggcgaaaacugcacacuaaucgacgcacuccuuggagacccccaaugcgacggauuccaaaacaagaaaugggaccucuucgucgaacgaagcaaggcuuacuccaacugcuaccccuacgacguucccgacuacgccagccuaagaucccuagucgccucaagcgguaccuuagaguucaacaacgagagcuucaacugggcaggcgucacccaaaacggcacuuccuccgccugcaaaagaggcagcaacuccucauucuucucacgccucaacuggcucacccaccuaaacuuuaaauaucccgcccuaaacgucaccaugcccaacaacgaacaauucgacaaauuauacauuuggggaguccaccaccccgucaccgacaaagaccaaauuuuccuguacgcacaaagcagcggccgcauaaccguaucaaccaagcgaucacaacaagccgucaucccaaacaucggauaccgaccuaggauccgaaacauccccucacgcaucuccaucuacuggaccaucgucaaacccggugacauccuccucaucaacagcaccggaaacuuaauagccccacgcggauacuuuaaaauccgcucaggaaaaagcucaaucaugcgcucugacgcgcccaucggcaaaugcaaauccgaaugcauaacccccaacgggagcaucccaaacgacaagccauuccagaacguaaaccgcauaaccuacggagccugcccccgcuacgucaaacagucaacccucaaacucgccaccggcaugcgaaacgucccagaaaagcagacaagaggcaucuucggcgccaucgcaggcuucaucgaaaacggcugggaagggauggucgacggcugguacggcuucagacaccagaacuucgaaggacguggccaagcagcugaccucaaauccacccaagcagccauagaccagaucaacggcaagcucaaccgccuuaucggcaaaacaaacgaaaaauuccaccaaauagaaaaagaguucagcgaagucgaaggaagaauacaggaccuagaaaaauacgucgaagacacaaaaauagaccuaugguccuacaacgccgaacuccuggucgcacuagaaaaccagcacacaaucgaccucaccgacucagaaaugaacaaacucuucgaaaagaccaagaaacaacuucgagaaaacgccgaagacaugggcaacggcugcuucaaaaucuaccacaaaugcgacaacgccugcauaggcucgauccggaacggaacauacgaccacgacguauaccgcgacgaagcacucaacaacagauuccaaaucaaaggagucgaacucaaaagcggcuacaaagacuggauacucuggaucaguuucgccauaagcugcuuccugcuaugcgucgcgcuccuaggcuucaucaugugggcaugccaaaaaggcaacauccgaugcaacaucuguaucuga

SEQ ID NO: 215735 - RNA, 1701 nt, Artificial Sequence
  derived and/or modified sequence opt from Influenza A H3N2 hemagglutinin
augaaaacuaucaucgcacucuccuacauacuaugccuaguauucgcccagaaaaucccaggcaacgacaacuccacagccacccucugccucggacaccaugccguacccaauggaaccauagucaaaacaaucacaaacgacagaaucgaagucaccaaugccacagaacucguacaaaacuccaguauaggcgaaauuugcgacuccccacaccaaauccucgacggcgaaaacugcacacuaaucgacgcccuacucggagacccacaaugcgacggauuccaaaacaagaagugggaccuguucguggaacgauccaaagccuacucaaacugcuaccccuacgacguaccagacuacgcgucacuccgcucacuuguagcaagcagcggcacccucgaguucaacaacgaauccuucaacuggaccggcgucacccaaaacgggacauccucggccugcaucagaggcuccuccagcucguucuucucccggcugaacuggcucacacaccuaaacuacaaauacccagcacuaaacgucaccaugccaaauaaugaacaauucgacaagcucuacaucuggggcguccaccaccccggcaccgacaaagaccaaaucuucccauacgcccaaucgagcgggcgcaucacagucagcaccaaaagaucacagcaagccgucauaccaaacaucggcucccgcccacgcauccgaggaaucccaagccgaaucuccaucuacuggacgauagucaaacccggcgacauccuccucaucaacagcaccggcaaccucauagcaccccgcggauacuucaaaauccgauccgguaaauccucaauaaugcgcagcgacgccccuaucggcaaaugcaaguccgaaugcauaacaccaaacggauccauacccaacgacaagcccuuccagaacgucaauaggauuaccuacggcgcaugcccacgcuacgucaagcacuccacccucaaacucgcuaccggcaugcgcaacguacccgaaaagcaaacccgagggaucuucggcgcgauagccggcuucaucgaaaacggcugggaaggcauggucgacggcugguacggcuuccgccaucaaaacucggaaggacgcggacaagcggccgaccucaagucaacccaagcagccaucgaccaaauaaacggaaagcucaaccgccucaucggcaaaaccaacgaaaaauuccaccaaaucgaaaaagaguucuccgaagucgaaggcagaauacaagaccuugaaaaauacguagaagacacaaaaaucgaccugugguccuacaaugcagaacuccuugucgcccuagaaaaccaacauacaauugaccucaccgacuccgaaaugaauaagcucuuugaaaagaccaagaaacagcucagagaaaacgcagaagacaugggcaacggcugcuucaaaaucuaccacaaaugcgacaacgccugcauaggcuccauccgcaacggaaccuacgaccacaacguauaccgcgacgaagcccucaacaaccguuuccaaaucaaaggcgucgaacuaaaaucgggcuacaaagacuggauccucuggaucagcuucgccauaagcugcuuccuccuaugcguggcacuacucgguuucaucaugugggccugccaaaaaggaaacaucagaugcaacauauguauauag

SEQ ID NO: 215736 - RNA, 1701 nt, Artificial Sequence
  derived and/or modified sequence opt from Influenza A H3N2 hemagglutinin
augaagaccauaaucgcacucucauacauccuaugucucgucuucgcacaaaagauccccggcaacgacaacuccaccgccacccuaugccuaggacaccacgccguccccaacggcacuaucgugaaaaccaucaccaacgaucguaucgaagucacaaacgccacggaacucguccaaaacucauccaucggcgaaaucugcgauucaccccaccaaauccuagacggcgaaaacugcacacuaaucgacgcacuacucggcgacccccagugcgacggcuuccaaaacaaaaagugggaccucuucgucgaacgcuccaaagccuacuccaacugcuaccccuacgacguaccagacuacgcaagccuacguagccucguagccucguccggcacacucgaguucaacaacgaaucuuucaacuggacgggcgucacccaaaacggcacauccagcgccugcauacgacgcuccuccucuucguucuucagccgccuuaacuggcugacccaccuaaacuacaaguaccccgcacuaaacgucaccaugcccaacaacgaacaauucgacaaacucuacaucuggggaguacaccaucccggaaccgacaaagaccaaauuuucccauacgcccaaagcucaggacgaauaaccguuuccacaaaacgcucccaacaagcggucauaccaaacauaggcucacgacccagaauacgcggaauccccucccgcauuuccauauacuggaccauaguuaaacccggcgacauacuccuuaucaacucuacgggcaaccuuaucgcccccagaggcuacuucaaaauaagaucugggaaaagcucuaucaugcgaucagaugcgcccaucggcaaaugcaaguccgaauguauaacccccaacggcagcauaccuaacgacaagcccuuccaaaaugucaacagaaucaccuacggcgccugcccccgauacgucaaacacucaacccucaaacucgccacaggcaugcgaaacguccccgaaaaacaaacccgcggcauauucggagccaucgcaggauucauugaaaacggcugggaaggaauggucgacggcugguacggcuuccgacaccaaaauucagaaggcagaggccaagccgccgaucuaaaauccacccaagccgccaucgaccaaauaaacggcaaacucaaccgccugaucggcaaaaccaacgaaaaauuccaccaaaucgaaaaagaguucucagaaguagaaggccgcauucaagaccucgaaaaauacgucgaagacaccaaaauagaccucugguccuacaacgccgaacuccuaguagcccucgaaaaucaacacacgaucgaccucacugacuccgaaaugaacaaacucuucgagaaaaccaagaaacaacuacgagaaaacgccgaagacaugggcaacggcugcuucaaaaucuaccacaaaugcgacaacgcaugcaucggcucaauccgaaacggcacguacgaccacaacgucuaccgcgacgaagcccucaacaaucgcuuccaaaucaaaggcguagaacucaaauccggauacaaagacuggauacucuggauaucauucgccaucuccugcuuccugcuaugcgucgcccuccuaggcuucaucaugugggccugccaaaaaggaaacauacgcugcaacaucugcaucuaa

SEQ ID NO: 215737 - RNA, 1701 nt, Artificial Sequence
  derived and/or modified sequence opt from Influenza A H3N2 hemagglutinin
augaaaacaaucaucgcccuaagcuacauccuaugccucguguucgcccagaagauccccggcaacgacaacuccacagccacacugugccucggacaccacgcaguccccaacggcacaaucguuaagacaaucacaaacgaccgaauagaaguaacaaacgccaccgagcuaguccaaaacagcucaauuggcgaaaucugcgacucaccccaccaaauccuagauggcgaaaacugcacccucaucgacgcccuacuaggagacccucaaugugacggcuuccaaaacaagaaaugggaccucuucgucgaaagaagcaaagccuacagcaacugcuaccccuacgauguccccgacuacgccagccuucgaucgcucguagcauccuccggcacucuagaguucaauaacgaaucguucaauuggacaggcguaacccaaaacgguacauccucagccugcauacgcagauccucauccucauucuucagccgacucaauuggcucacccaccucaacuacacguacccagcccuaaacgucaccaugccaaacaacgaacaauucgacaaacuauacaucuggggcguccaccaccccggaaccgacaaagaccaaaucuuccuuuacgcacaaucgagcgggcgcaucaccgucucaacaaaaaggagccagcaagccgucaucccaaacaucggaucgcgccccagaauccgagacauaccauccagaauauccauauacuggaccauagucaaacccggugacauccugcuaaucaauagcacaggcaaccucaucgcaccccgcggcuacuucaaaauccgcucggguaaaucuagcaucaugcguucagacgcccccauugguaagugcaagucagaaugcaucacaccaaacggcucuauccccaacgacaaaccauuccaaaacgucaacagaaucaccuauggagcuugcccgcgcuacgucaaacacucaacccucaaacuggccacugggaugcgaaauguaccggaaaaacaaacccgaggcaucuucggugccaucgcaggcuucaucgaaaacggaugggaaggcauggucgacggaugguacggauuccgacaccaaaacucagaaggacgcggccaagcagccgaccucaaauccacacaagccgcaaucgaccaaaucaacggcaagcucaacagauugauagggaaaacgaacgaaaaauuccaccagauagaaaaggaguucagcgaagucgaaggccgaauccaagacuuggaaaaauacguagaagacacaaaaaucgaccuguggucauacaacgccgaacuccuagucgcccucgaaaaccaacacaccaucgaccucacagacuccgaaaugaacaaacucuucgagaaaaccaagaaacaacuccgggaaaacgccgaagacauggguaacggcugcuucaaaaucuaccacaaaugcgacaacgcaugcaucggaucgaucagaaacggaacauacgaccacaacguguaccgcgacgaagcccugaacaaccgauuccaaaucaaaggugucgaacucaaaagcgguuacaaagacuggauccucuggaucagcuucgcaauauccugcuuccuacucugcgucgcccuccuuggcuucauaaugugggccugccaaaaaggaaacauacgcugcaacaucugcaucuaa

SEQ ID NO: 215738 - RNA, 1701 nt, Artificial Sequence
  derived and/or modified sequence opt from Influenza A H3N2 hemagglutinin
augaaaaccaucauagccuucuccugcauccugugccucauauucgcccaaaaacucccaggcuccgauaacagcauggccacccucugucuaggacaccacgccguaccuaacggcacccucgucaaaacaauaaccgaugaccaaaucgaagugacaaacgccaccgaacucguacagucaucgucaacaggccgcaucugcaacagcccacaucaaauccucgacggcaagaacugcacccucaucgacgcccuucucggagacccccacugcgacgaccuacaaaacaaagaaugggaccucuucguagaacgcucaaccgcuuacagcaauugcuaccccuacuacguaccagacuaugccacauuacgaagccuuguagcaucauccggaaaccuggaguucacccaagagagcuucaacuggaccggcguugcccaagacgggagcuccuacgccugcagacgcggcucugugaacucauucuucagccgacugaacuggcucuacaaccuaaauuacaaauaccccgaacaaaacgucaccaugcccaacaacgacaaauucgacaaacucuacaucuggggcguccaccaccccggcaccgacaaagaccaaacaaaccucuacguccaggcaucuggacgcgucaucgucagcacgaaacgcagccaacagaccgucauacccaacaucggcuccagacccuggguccgagguguaucaucuaucauaagcaucuacuggacaauagucaaacccggagacauacuccucauaaacagcacaggaaaccuaaucgccccacgaggcuacuucaaaauccaaucgggcaaauccuccaucaugcgcuccgacgcacacaucgacgaaugcaacagcgaaugcaucacacccaacggaagcauccccaacgacaaacccuuucaaaacgugaacaaaaucaccuacggagccugcccacgcuacgucaagcaaaacacacucaaacucgccaccggcaugcgcaacguucccgaaaagcaaacccgcggaauauucggagccauagccggcuucaucgaaaacggcugggaaggaaugguagacggaugguacggcuuucgacaccaaaacucagaagggaccggccaagcagccgaccuaaaaagcacgcaagcagccaucaaccagaucaccggaaagcucaaccgaguaaucaagaaaacaaacgaaaaauuccaccaaaucgaaaaagaguucuccgaagucgaaggacgaauccaagaccucgaaaaauacgucgaagacaccaaaauagaccucuggucguacaacgcugaacugcucguagcccucgaaaaccaacacacgaucgaccucaccgacuccgaaaugagcaaacuauuugaacggacccgacgucagcuccgagaaaacgccgaagacaugggaaacggcugcuucaaaaucuaccacaaaugcgacaacgcaugcauagguucaaucaggaacggaaccuacgaccacgacaucuaccgcaacgaagcacucaacaaccgauuccaaaucaagggaguccagcucaaaagcggcuacaaggacuggauccuguggaucagcuucgcuauauccugcuuccuccucugcgucguccuccuaggcuucauaaugugggccugccagaaaggcaacauacgcugcaauauaugcauauaa

SEQ ID NO: 215739 - RNA, 1701 nt, Artificial Sequence
  derived and/or modified sequence opt from Influenza A H3N2 hemagglutinin
augaaaacaaucauagccuucucaugcauccucugccucaucuucgcccagaagcuccccggcucagacaacuccauggcaacccucugccuaggacaccacgccgucccaaacggcacccuagucaaaaccaucaccgacgaccaaaucgaagucaccaaugccaccgaacucguccaauccucauccaccggccgcaucuguaacucaccacaccaaauacuagacggcaaaaacugcacccucaucgacgcacucuuaggagacccgcacugcgacgaccuccaaaauaaagaaugggaccucuucgucgaaagauccaccgccuacagcaacugcuaccccuacuauguacccgacuaugccacucuacgcucccucgucgccucguccggaaaccucgaguucacacaagaaaguuucaacuggacaggcgucgcacaagacggcuccuccuacgccugccgccgaggcuccguaaacagcuucuucucccgacuaaacuggcuguauaaacuaaacuacaaauaccccgaacaaaacguaacaaugcccaacaacgacaaauucgacaaacucuacauauggggcguacaccacccaggcacagacaaagaccaaaccaacauauauguacaagcauccggccgcguuaucgucuccaccaaaagaucccagcagacugucauccccaacaucggcagccgccccuggguccgcggcgucucauccaucaucuccaucuacuggacaaucguuaagcccggagacauccuccuaaucaacuccaccggcaaccuaauagcacccagaggauacuucaaaauacagucuggcaaaagcucaaucaugcgcuccgacgcccacaucgacgaaugcaacuccgaaugcauaacacccaacgguucaauccccaacgacaaaccauuccaaaaugucaacaagaucaccuacggcgccugcccaagauacguuaaacaaaacacccugaagcucgccacaggaaugcgcaacguaccggaaaaacagacccgaggcaucuucggcgccauagcuggcuucaucgaaaacggaugggaaggcauggucgacggcugguacggauuccgccaccaaaauuccgaaggcacaggccaggccgccgaccucaaauccacacaggccgcaauaaaccaaaucacaggaaaacucaaccgcgucaucaagaaaaccaacgaaaaauuccaccaaaucgaaaaagaguucagcgaagucgaaggucgcauccaggaccucgaaaaauacgucgaagacacaaaaauagaccugugguccuacaacgccgaacuccucgucgcacuagaaaaccaacacacaaucgaccuuaccgacuccgaaauguccaaacuauucgaacgaacucgccgucagcuucgagaaaacgccgaagacaugggcaacggaugcuucaaaauuuaccacaaaugcgacaacgccugcauaggcucaauaagaaacggcaccuacgaccacgacauuuaccgcaacgaagcccucaacaaccgcuuucaaauuaaaggcguccaacucaaauccggcuauaaagacuggauccuguggaucuccuucgccauaucaugcuuccuacucugcgucguccuacuaggcuucauuaugugggccugccaaaaaggaaacauccgcugcaacauaugcauuuaa

SEQ ID NO: 215740 - RNA, 1701 nt, Artificial Sequence
  derived and/or modified sequence opt from Influenza A H3N2 hemagglutinin
augaaaaccaucaucgcauucucaugcauccucugccucaucuucgcccaaaaacuacccggaucggauaaaagcauggcaacccuaugccuagggcaccacgcagucccaaacggaacacucgucaaaaccauaacugacgaccagauagaagucaccaacgccacagaacugguccaaagcuccagcaccucucgaaucugcaacuccccacaccagauacuugacggcaaaaacugcacacuaaucgacgcccuccucggcgacccccacugcgacgacuuccaaaacaagaaaugggaccucuucgucgaaagauccaccgccuacuccaacugcuaccccuacuacguccccgacuacgccacacuccgaagccucauugcauccagcggcaaccucgaguucacccaagaaucauucaacuggacaggcgucgcacaagacggcucauccuacgccugcaggcgcggcagcgucaacucauucuucucaagacucaacuggcucuacaaccucaacuacaaauacccugaacaaaacgugacaaugcccaauaacgacaaauucgacaaacuauacaucuggggcguccaccacccugggacagacaaagaccaaacuaaccuauacguccaagcaaguggccgcguaaucgucucaaccaaacgcucacaacaaacugucauaccuaacaucggcucccgccccugggugcgcggcgucuccucaauaaucucaauauacuggaccaucgucaaacccggugacauacuccuaauaaacuccacagguaaccuaaucgcaccccgcggcuacuucaaaauucaauccggcaaaucuagcaucaugcgcuccgacgcccauaucgacgaauguaacuccgaaugcaucacccccaacggcuccauccccaacgacaaacccuuccaaaaugucaacaaaaucaccuacggcgccugcccacgauacguaaagcagaacacucucaaacucgccaccgguaugcgcaacguaccagaaaaacaaacccggggcauauucggcgcaauagccggauucauugaaaacggcugggaaggcauggucgacggcugguacggguuccgucaucaaaacucagaaggcaccggccaagcggccgaccucaaaucgacacaagccgccauaaaccaaaucaccggcaaacuaaaccgcgucaucaagaaaaccaacgaaaaauuccaccaaaucgaaaaagaguucucagaaguagaagggcgcauccaagaccucgaaaaauacgucgaagacaccaaaaucgaccuauggucauacaacgccgaacuacuugucgcgcucgagaaccagcacacaaucgaccuaaccgacagcgaaauguccaaacucuucgaacgaacucgccgccagcuccgcgaaaacgccgaagacaugggaaacggcugcuucaagaucuaccacaaaugcgacaacgcaugcaucggcagcauacgcaacggaaccuacgaccaugacaucuaccgcaacgaagcccucaacaaccgcuuccaaauaaaaggcguacaacucaaguccggauacaaagacuggauccucuggaucagcuucgccauauccugcuuccuacucugcguagugcuccucggauucaucaugugggcaugccagaaaggcaacauccgcugcaacaucugcauauaa

SEQ ID NO: 215741 - RNA, 1701 nt, Artificial Sequence
  derived and/or modified sequence opt from Influenza A H3N2 hemagglutinin
augaagaccauaaucgccuucuccugcauccucugccucaucuucgcccaaaaacuccccggaucagacaacuccauggcgacacucugccuaggacaccacgccguacccaacggcacucucgucaaaaccauaacagacgaccaaauagaagucaccaacgcaaccgagcuaguccaauccucauccaccggacgcaucugcaacuccccacaccaaauacucgacggcaaaaacugcaccuugaucgacgcccuacuaggagacccccacugcgacgacuuccaaaacaaggaaugggaccucuucgucgaacgauccaccgcauacucaaauugcuaccccuacuauguccccgacuacgccacccuaagaucccuagucgccagcagcggaaaccuagaguucacccaagaauccuucaacuggaccggcguagcacaggacggauccucuuacgcgugccgacguggaucaguaaacucguucuucucccgccuaaacuggcucuacaaccucaacuacaaauacccagaacaaaacgugaccaugcccaacaaugacaaauucgacaaacucuacaucuggggaguccaccaccccggaacugacaaggaccaaacaaaucuauauguccaagccuccggccgcgucaucguaagcaccaaacgcagccaacaaacaguaauccccaacaucggcucccgccccuggguccgcggcgucuccucaaucauaagcauauacuggacaaucguaaaacccggagacauccuacugauaaacuccacgggaaaccuuaucgcuccccggggcuacuucaaaauccaauccggcaaauccucaaucaugcgcuccgacgcccacaucgacgaaugcaacucagaaugcaucaccccaaacggcuccaucccaaacgacaaaccuuuccaaaacguaaacaaaaucaccuacggagccugcccccgcuacgucaaacagaacacacuaaaacucgccaccgguaugcgcaacguaccagaaaaacaaacacgcggaaucuucggcgcaaucgccggcuucaucgaaaacggcugggaaggcaugguugacgguugguacggcuuccgacaccaaaacagcgaaggcaccggccaagcagccgaucucaaauccacccaagccgccauuaaccaaaucaccggcaaacuaaaccgcgucaucaagaaaacgaacgagaaauuccaccaaaucgagaaagaguucuccgaagucgaaggacgcauacaagaccucgaaaaauacgucgaagacaccaaaauugaccucugguccuauaacgccgaacuauuagucgcucuagagaaccaacacaccaucgaccuaaccgacucagaaauguccaaacuuuucgaacggacccgucgccaacuccgagaaaacgccgaagacauggggaacggcugcuucaaaaucuaccacaaaugcgacaacgccugcaucggcuccauacgaaacggcaccuacgaccacgacaucuaccgcaacgaggcacucaacaaccgcuuccaaaucaaaggcguccagcuuaaaucaggcuacaaagacuggauccuuuggauuucauucgcaauaucuugcuuccuacucugcgucguccuccuaggcuucaucaugugggcgugccaaaaaggaaacauccgcugcaacauaugcauauga

SEQ ID NO: 215742 - RNA, 1701 nt, Artificial Sequence
  derived and/or modified sequence opt from Influenza A H3N2 hemagglutinin
augaaaaccaucauagccuuuuccugcauccucugccucauauucgcacaaaaacuccccggcagcgacaacuccauggccacccucugccugggccaccacgccguacccaacggcacccuagucaagacaaucaccgacgaucaaaucgaagugaccaaugcuacagaacucguccaaagcagcagcaccggccggaucugcaacucaccacaccaaauccuagacggcaaaaacugcacccuaauagacgcccuccuaggcgacccacacugcgacgauuuccaaaacaaagaaugggaccucuucguagaacgauccacagccuacucuaacugcuauccauacuacguccccgacuacgccacccugcgcucccuaguagccuccuccggaaaccucgaguucacccaagaguccuucaacuggacgggcgucgcccaagacggaucaucauacgcgugccgacgcggauccgucaacagcuucuucagccgacugaacuggcucuacaaccugaacuacaaauaccccgaacaaaacgucaccaugccaaauaacgacaaauuugacaaacucuacaucuggggcgugcaccacccagggaccgauaaagaccaaacgaaacuauacguccaagcgagcggccgcgugauagucucaacuaaacguagccaacaaaccgucauacccaacaucggcucacgacccuggguccgaggcguaucaucaaucaucuccaucuacuggaccauagucaagccaggcgacauccuccucauaaacagcaccggaaaccucaucgccccucgcgguuacuucaaaauacaauccggcaaaagcucaaucaugcgcuccgacgcccacaucgacgaaugcaacagcgaaugcauaacccccaacggcagcauccccaacgacaaaccauuccaaaacguaaauaaaaucaccuacggcgcaugcccccgauacguaaaacaaaacacccuuaaacucgccacaggcaugcgaaacguccccgaaaaacaaacacgaggaaucuuuggcgcuauugccggcuucauagaaaacggcugggaaggaauggucgacggcugguacggauuccgacaccaaaacagcgaaggaacaggacaagcggcagaccucaaauccacacaagccgcaaucaaucaaaucaccggcaaacucaacagaguaaucaagaaaacaaacgaaaaauuccaccaaaucgagaaagaguucagcgaagucgaaggccgcauacaggaccuugaaaaauacguagaagacaccaaaaucgaccucugguccuacaacgccgaacuccuagucgcacucgaaaaccaacacacaaucgaccucacagacuccgaaauguccaaacuauucgaacggaccagacggcaacuccgagaaaaugccgaagacaugggcaacggcugcuucaaaauauaccacaaaugcgacaacgcaugcauagguuccauacgcaacgggaccuacgaccacgacauuuaccgaaacgaagcccucaacaaccgauuccaaauaaaaggcguacaacucaaaucaggcuacaaagacuggauccucuggaucucguucgcaauauccugcuuccuccuuugcgucguacuccuaggcuucaucaugugggcaugccagaaaggcaacauccgaugcaacauaugcauauga

SEQ ID NO: 215743 - RNA, 1701 nt, Artificial Sequence
  derived and/or modified sequence opt from Influenza A H3N2 hemagglutinin
augaaaaccauaaucgccuucucuugcauacuaugccuaaucuucgcacaaaaacucccggggagugacaacucuauggccacccucugccucggccaccacgccguacccaacggaacgcuagucaaaaccauaaccgacgaucagaucgaagucaccaacgccaccgaacucguccaaagcagcuccacaggccgcaucugcaacucaccacaccaaauacucgacggcaagaacugcacccucauagacgcccuccuaggcgacccccacugugacgacuuucaaaacaaggaaugggaucuauucgucgaacgcucuacagccuacagcaacugcuacccauacuacgucccugacuacgccacccuucgcucccucgucgccuccagcggaaaccuggaguucacccaagaauccuucaauuggacaggcgucgcccaagacggcuccucauacgcgugccgccgaggcagcguaaacagcuucuucucccgccucaacuggcucuacaaucuaaacuacaaauacccagaacaaaacguaacaaugccaaacaacgacaaauucgacaaacuuuacaucuggggaguccaccaccccggcaccgacaaagaccaaaccaaaauauacguucaagcguccggacgcgucaucguaucuacaaaacgaagccaacaaaccguaauaccaaacaucggcucucgccccuggguccggggugucagcucaaucauaagcaucuacuggacaaucgucaagccuggcgacauacuacuaaucaacagcacaggcaaccucauagcaccacgaggcuacuuuaaaauucaauccggaaaaucuuccaucaugagauccgacgcgcacaucgacgaaugcaacuccgaaugcaucaccccgaacggcucuauacccaacgacaaacccuuccaaaacgucaacaaaaucacauacggagcgugcccacgauacgucaagcaaaacacccuaaaacuagccacaggcaugcgcaacguccccgaaaagcaaacacgcggcauauucggcgcaauagccggcuucaucgaaaacggaugggaaggcaugguagacggcugguacggauuccgacaccagaacuccgaaggcaccggacaagccgcagaccucaaaagcacccaagcagccaucaaucaaaucacaggcaaacucaaccgcgucaucaagaaaacaaacgaaaaauuccaccaaaucgagaaagaguucuccgaagucgaaggacgcauccaagaccucgaaaaauacguagaggacaccaaaauagaccucugguccuacaacgcagaacuccuaguagcacuagaaaaccaacacacgaucgaucuaaccgacagcgaaaugagcaaacucuucgaacguacacgacgacaacuacgcgaaaacgccgaggacaugggcaacggaugcuucaaaaucuaccacaaaugcgacaacgcaugcauaggcuccauccguaacggaaccuacgaccacgacaucuaccgcaaugaagcccugaacaaccgcuuccaaaucaaaggaguccaacucaaaucaggcuacaaagacuggauccuauggauaucuuucgcaaucuccugcuuccuacucugcguuguacuacucggauucaucaugugggcaugccaaaaaggaaacauccggugcaacauuugcaucuaa

SEQ ID NO: 215744 - RNA, 1701 nt, Artificial Sequence
  derived and/or modified sequence opt from Influenza A H3N2 hemagglutinin
augaaaacaauaauagccuucuccugcauacuaugccucaucuucgcccaaaaacuacccgguuccgacaacucuauggccacccucugccucggccaccacgccgugcccaacggcacccuagugaaaaccauaacagacgaccaaaucgaagucaccaacgccaccgaacucguccaauccucaagcacgggacgcaucugcaacucaccccaucaaauccuagacggcaaaaacugcacccugaucgacgcgcugcuuggggacccucacugcgacgacuuccaaaacaaagaaugggaccucuucgucgaacgcuccacagccuacuccaacugcuacccauacuacguccccgacuacgcaacccucaggucccucguagcauccuccggaaaccucgaguucacccaggaaucuuucaacuggacaggcguagcccaagacggcuccuccuacgccuguagacgaggcagcguaaacuccuucuucucccgucuuaacuggcuauacaaccucaacuacaaauacccggaacaaaacgucaccaugccaaacaacgacaaauucgacaaacucuacauauggggcguccaccaccccggaaccgacaaagaccaaacaaaaaucuacguccaagcaucaggacggguaaucgucagcaccaagcgcucccagcaaaccgucauccccaacaucggcucgagaccauggguacgaggagucucuucaauaaucagcauauacuggacuaucguaaaacccggagacauccuccuaaucaacuccacaggcaaccucauagcaccccgcggauacuucaaaauccaaucaggcaaguccuccaucaugcgcuccgacgcccacauagacgaaugcaacuccgaaugcaucaccccaaacggauccauuccuaacgacaagcccuuccaaaacguuaacaaaauaaccuacggagccuguccccgauacgucaaacaaaacacacucaaacuugccacaggcaugcgcaacguacccgaaaaacaaacccgcggcaucuucggcgccauagccggcuucaucgagaacggcugggagggaaugguagacggcugguacggcuuccgucaucaaaacuccgaaggaaccggacaagcugccgaccuuaaaucgacccaagccgccauuaaccaaaucacuggaaaacuaaaccgcguaauaaagaaaaccaacgagaaauuccaccaaaucgaaaaagaguucuccgaagucgaaggccgcauccaagaccuugaaaaauacguagaagacacaaaaaucgaccucugguccuacaacgccgaacuccucgucgcccucgaaaaccaacacaccauagaccucaccgacuccgaaauguccaaacuauucgagcguacacggcgccaacucagagaaaacgccgaagacaugggcaacggcugcuucaaaaucuaccacaaaugcgacaacgcgugcaucggauccauccgaaacggaaccuacgaccacgacaucuaccgaaacgaagcacucaacaaucgcuuccaaaucaaaggcguccagcucaaaagcggcuacaaagauuggauccuauggaucucauucgccauaagcugcuuccuccucugcguaguccuauuaggcuucauaaugugggccugccagaaaggcaacauccgcuguaacauaugcauauaa

SEQ ID NO: 215745 - RNA, 1701 nt, Artificial Sequence
  derived and/or modified sequence opt from Influenza A H3N2 hemagglutinin
augaaaaccauaaucgcccuaagcuacauccucugccucgucuucgcccaaaaacuaccaggaaacgacaacagcacagccacacuuugccugggacaccacgccguccccaacggcaccauaguaaaaaccauaaccaacgaccgcauagaagucaccaacgccacagaacucguccaaaacuccagcauuggcgaaaucugcgacucgccccaccaaauacucgacggcaagaacugcacccuaaucgacgcacuacuaggcgacccccaaugcgacggcuuccagaacaaacgcugggaucuauucguugaaagaagcaaagcauacucaaacugcuaccccuacgauguccccgacuacgcgagccuucgcucucucguagcaucaucuggaacccucgaguucaacgacgaauccuuuaacugggccggcguaacccagaacgggaccucgagcgccugcauacgaggcaguaacagcucauucuucagccgccuaaacuggcuaacccacagcaacuucaaauauccagcacugaacgucaccaugcccaacaacgaacaauucgacaaacuauacaucuggggaguccaccaccccggaaccgacaaagaucaaauauuccucuacgcacacuccagcggacgcaucacaguaagcaccaaaagaagccaacaagccgugauaccuaacaucggcucccgaccacggaucagaaacaucccgucccgcauauccaucuacuggaccaucgucaaaccaggcgacauccuccuaaucaacuccacaggaaacuuaauagcuccccgcggauacuucaaaauacaaucaggcaaaagcuccaucaugcgauccgacgccccuauagggaaauguaaauccgaaugcaucacccccaacggaagcauccccaacgacaaacccuuccaaaauguaaaccgcauaaccuacggagcgugcccccgauacgucaaacaauccacccuaaaacucgccacgggcaugcgcaacgucccagaaaaacaaaccagaggcauauucggagccaucgcgggcuucaucgaaaacggcugggaaggcaugaaagacggcugguauggauuccgccaccaaaacuccgaaggccgaggccaagccgccgaccucaaaagcacccaagccgccaucgaccagauaaacggcaaacucaaccgacucaucggcaaaaccaacgaaaaauuccaccaaaucgaaaaagaguucucugaaguagaaggacgcauacaagaccuagaaaaauacgucgaagacacuaaaauagaccuauggucauacaacgccgagcucuuggucgcacuagaaaaccagcacacgaucgaccucacggauuccgaaaugaacaaauuauucgagaaaacaaagaaacaacuccgagaaaacgccgaagacaugggcaacggaugcuucaaaaucuaccacaaaugcgacaacgccugcauuggauccauccggaacgggacauacgaccaugacgucuaccgcgacgaagcccuaaacaaccgcuuccaaaucaaagggguagaacuaaaauccggauacaaggacuggauccuuuggauuuccuucgccaucagcugcuuccuccuaugcgucgcccuccuaggcuucauaaugugggcaugccaaaaaggcaacauccgcugcaacauaugcaucuga

SEQ ID NO: 215746 - RNA, 1701 nt, Artificial Sequence
  derived and/or modified sequence opt from Influenza A H3N2 hemagglutinin
augaaaaccaucaucgcacucucguacauacucugccucgucuucgcucagaaaaucccgggcaaugacaacaacacugccacccucugccucggacaccacgcaguccccaacggcacgaucgucaaaacaaucacgaacgaccgcaucgaagucaccaacgccaccgaacucguccaaaacuccuccauaggcgaaauaugcgacagcccccaccaaauccuagacggcgaaaacugcacucucauagacgcccuucucggcgacccacaaugcgacgguuuccaaaacaagaaaugggaccucuucguagaacgcuccaaagcauacagcaacugcuacccauacgacguaccagacuacgccucacuccgcucccucgucgccagcagcggcacccuagaguucaauaacgaauccuucaacuggaccggcgucacccaaaacggaaccuccuccgccugcauucgacgcucauccucauccuucuucucccgccucaauuggcucacccaccucaacuacaaauacccagcacucaaugucaccaugcccaacaacgaacaauucgacaaacuauacauauggggcguacaucacccuggcaccgacaaagaccaaauauucccauacgcccaaucgagcggccgcauaaccgucagcacaaaacguucccaacaagccgucauccccaauaucggcucccgaccacgcauacggggcauacccucccgaauaucaaucuacuggaccaucgucaagccaggagacauccuccuaauaaacagcacaggcaaucucaucgcuccacgcggguacuucaaaauccgcuccggaaaauccagcaucaugcgaucggaugcccccaucggcaaguguaaaagcgaaugcaucacaccaaacggcagcaucccaaacgacaaacccuuccaaaacgucaaccgcaucaccuacggcgcaugcccccgcuacgucaaacacucaacccucaagcucgcaaccggcaugagaaacgucccggaaaaacagacacguggaaucuucggcgcaaucgcgggcuucaucgaaaacggcugggaaggcauggucgauggcugguacggauuccgccaccaaaacucagaaggccgcggucaagccgccgaccuaaaaagcacccaagccgccauagaccagauaaacgguaaacucaaccgacuaauaggcaaaaccaaugaaaaauuccaccaaaucgaaaaagaauuuucagaagucgaaggccgaauacaagaccuugaaaaauauguagaagacaccaagaucgaccugugguccuacaacgcugaacuacuuguagcccucgaaaaccaacacaccauagaccugaccgacucugaaaugaacaaacucuucgagaaaacaaagaaacaacugcgcgaaaacgccgaagacaugggaaacggcugcuucaaaaucuaccacaaaugcgacaacgccugcauuggcuccauacgcaacggaacuuacgaccacaacgucuaccgggacgaagcauugaacaaccgauuccaaaucaaaggcgucgaacuaaaaucaggcuacaaagacuggauccuauggaucaguuuugccaucagcuguuuccuauuaugcgucgcccuccuagguuucauaaugugggccugucaaaagggcaacauacgcugcaacaucugcaucuaa

SEQ ID NO: 215747 - RNA, 1701 nt, Artificial Sequence
  derived and/or modified sequence opt from Influenza A H3N2 hemagglutinin
augaaaaccaucaucgcccuaucuuacauccucugccucgucuucgcccagaaaauccccggcaacgacaacaauacagcaacacucugccuuggccaccacgccguccccaacgguacaauaguaaaaaccauaaccaacgaccgcauagaaguuaccaacgccaccgagcuaguacaaaacucaagcaucggcgaaaucugcgacucaccccaccaaauccucgacggcgaaaacugcacccuaauagacgccuugcucggggacccucaaugcgacggauuccaaaacaagaaaugggaccuauucgucgaacggagcaaggcuuacuccaacugcuaccccuacgacgucccagacuacgccucccuccgcucccuaguagcaucauccggaaccuuagaguucaacaacgaaucauucaacuggacaggcgucacccaaaacgggacuucgagcgccugcauccgccgaagcagcuccagcuucuucagcagacuaaacuggcucacccaccucaacuacaaauacccagcccugaacgucaccaugcccaacaacgaacaauucgacaaacucuacaucuggggagugcaccaccccgggacagacaaagaccagauauucccauacgcgcaaucaucaggacgcaucaccgucagcaccaaaagaucccaacaagccguaauacccaacaucggcuccagaccccgaauccgcggcauuccaucucgcauaaguauauacuggaccauaguaaaacccggagacauccuccucaucaacagcaccggcaaccuaaucgccccgagaggcuacuucaaaauaagaaguggcaaaagcucaaucaugcgcuccgacgccccaaucggcaaaugcaaaagcgaaugcauaacccccaacgggagcauccccaacgacaaacccuuccaaaacgucaaccgcaucaccuacggcgccugcccaagauacgucaaacacuccacacucaaacuagcaacaggcaugcgcaacgucccagaaaaacaaacucguggcaucuucggcgccaucgccggcuuuaucgaaaacggaugggaaggcauggucgacggaugguacggauuccgccaccaaaacuccgaaggccgcggccaagcagccgaccuaaaaucaacacaagccgccauagaccaaaucaacggcaaacuaaaccgccuaaucggaaaaaccaacgagaaauuccaccaaaucgaaaaagaguucuccgaagucgaaggccgcauccaagaccucgaaaaauacguagaggacaccaaaaucgacuuauggucuuacaacgccgaacuccuaguagcucuagaaaaccagcauacaaucgaccucacagacuccgaaaugaacaaacucuucgagaaaaccaagaaacagcucagggaaaacgcagaagacaugggcaacggcuguuucaaaaucuaccacaaaugcgacaacgcgugcauaggcucuaucagaaacgggaccuacgaccacaacguauaccgggacgaagcccucaacaaccgcuuccaaauaaaaggcgucgaacuaaaauccggcuacaaagacuggauccuguggauaucauucgccauuuccugcuuucuccucugcgucgcacuacuaggcuucaucaugugggccugccaaaaagggaacauccgaugcaacauaugcauauaa

SEQ ID NO: 215748 - RNA, 1701 nt, Artificial Sequence
  derived and/or modified sequence opt from Influenza A H3N2 hemagglutinin
augaaaaccauaaucgcccucuccuacauccucugccuaguuuucgcacagaaaauaccaggcaacgacaacaacacggcaacccuaugccuaggccaccaugcggucccuaacggaaccaucgucaaaaccauaacaaacgaccgcaucgaagucacgaacgccaccgaacucguucaaaacuccagcauaggcgaaaucugugacuccccacaccaaauacuagacggcgaaaauugcacacuaauagacgcgcuacuaggugacccacaaugcgacggauuccaaaacaagaaaugggaccuguucguagaaagaagcaaagcauacagcaacugcuacccuuacgacgucccagacuacgcaucccucagaucacucgucgcaucauccggcacccuggaauuuaacaacgaaucauucaacuggacaggagucacccaaaacgggaccagcuccgccugcauccgccgcagcuccucauccuucuucucccggcucaacuggcuaacacaccucaacuacaccuacccagcccugaacgucaccaugccuaacaacgaacaauucgacaaacuuuacaucuggggcguccaccacccagggaccgacaaagaccaaaucuuccuauacgcccaauccagcggccgcaucaccgucuccaccaaaaggagccaacaagccguaaucccaaacauaggaagccgcccacgcauacgcgacaucccuucccgcauaucuauuuacuggacuauugucaaacccggagacauccuucuaaucaacucaaccggcaaccucauagccccacgcggcuacuucaaaauccgcucaggaaaaagcuccauaaugcgcucagacgcccccauaggcaaaugcaaaagcgaaugcaucacccccaacggcuccauccccaacgacaaacccuuccaaaacgucaaccgcauaaccuacggcgcaugcccccgcuacgugaagcacucgacacuaaaacucgccacaggcaugcgaaauguccccgaaaaacaaacccgaggcaucuucggugccaucgccggauucaucgaaaacggaugggaagggauggucgacggcugguacgguuuccgccaccaaaacucagaaggccgcggacaagccgccgaccuaaaaagcacccaagcagccaucgaccagaucaauggaaaacucaaccgccucaucggcaaaaccaaugaaaaauuccaccagauagaaaaagaguucuccgaaguugaaggacgaauccaagaccucgaaaaguacgucgaagauacaaaaauagaccucuggucguauaacgcagaacuccucguagcacucgaaaaccaacacaccaucgaccuaaccgacucugaaaugaacaaacuuuucgaaaagaccaagaaacaacuccgagaaaacgcugaagacaugggaaacggaugcuucaaaaucuaccacaaaugcgacaacgcaugcaucggauccauccgcaacgggaccuacgaccacaacgucuacagggacgaagcccuaaacaaccgauuccaaauaaaaggcgucgaacuaaaaagcggcuacaaagacuggauccuguggaucuccuucgccauuagcugcuuccuccucugcgucgcacuccucggcuucaucaugugggccugccaaaaagggaauauccguugcaacauaugcaucuga

SEQ ID NO: 215749 - RNA, 1701 nt, Artificial Sequence
  derived and/or modified sequence opt from Influenza A H3N2 hemagglutinin
augaagaccaucaucgcccucucauacauccuaugccucguauucgcccaaaagaucccuggcaacgacaauaacaccgccacgcuaugccuaggacaccacgcugugccaaacggaaccaucgucaaaaccauaacgaacgaccgcauagaaguaaccaacgccacagaacugguccaaaacucauccaucggugaaauuugcgacucuccccaucaaauccucgacggcgaaaacugcacacucauagacgcccuacucggcgacccccaaugcgacggcuuccaaaacaagaaaugggaccuauucgucgaacgauccaaagcauacagcaacugcuaccccuacgacgucccugauuacgcaucccucagaucccucguagccuccaguggcacacucgaguucaacaacgaaaguuuuaacuggaccggcgucacccaaaacggcacauccucagcgugcauccgcagauccuccucaucguucuucucacgccucaacuggcugacccaccucaacuacaaauacccggcccucaacguaacuaugcccaacaacgaacaauucgacaaacuauacauuuggggcguccaccacccaggcacagacaaagaccagaucuucccauacgcacaaucaucaggacgcauaaucgucuccacuaagcgcucccaacaagccgucauccccaacaucggcagccgcccccggauccgcgacauccccucccgcauaagcaucuacuggaccaucgucaaacccggagacauccuccucaucaauuccaccggaaaccuaaucgcccccagaggauacuucaaaauccgcagcggaaaauccagcaucaugcgaucggacgcgcccauuggcaaaugcaaauccgaauguauaacacccaacggcuccauccccaacgacaagcccuuccaaaaugucaaccgcauaaccuauggcgcaugcccccgcuacgucaagcauuccacccucaaacuggcaaccggaaugcgcaacguacccgaaaaacaaacccgagguaucuucggcgcuaucgccggauucaucgaaaacggcugggaaggaauggucgacggcugguacggguuccgccaccaaaacuccgaaggccgcggccaagccgccgaccucaaaagcacucaagccgccaucgaccaaaucaaugguaagcucaaccgccuuauaggcaagacgaacgaaaaauuccaccaaaucgaaaaagaguucucggaaguagaaggccgcauucaagaccuugaaaaauacgucgaagacacaaaaauagaccuaugguccuacaaugccgaacuccucguagcacucgagaaccaacacaccauugaccucaccgacagcgaaaugaacaaacucuucgagaaaaccaagaaacaacuccgugaaaacgcagaagacaugggaaacggcugcuucaaaaucuaccacaaaugcgacaacgcaugcauaggcucaauccgaaacggcacauacgaccacaacgucuacagagacgaagcccuaaacaauagauuccaaaucaaaggcgucgaacucaaauccggcuacaaagacuggauccuauggaucuccuucgccaucagcugcuuccuccuaugcgucgcccuccucggcuucauaaugugggcaugccaaaaaggaaacauacgcugcaacaucugcauauga

SEQ ID NO: 215750 - RNA, 1701 nt, Artificial Sequence
  derived and/or modified sequence opt from Influenza A H3N2 hemagglutinin
augaagaccaucaucgcacugagcuacauccuaugccuaguauuugcccaaaagaucccaggcaaugacaacaacaccgcaacccuuugccuaggccaccacgccgucccaaacggcaccauaguaaagaccauuaccaacgaccgcaucgaagucaccaacgcaacagaacucguccaaaacucaucaauaggcgaaaucugcgacagcccccaccaaauccucgacggcgaaaacugcacccucaucgacgcccuccucggcgacccccaaugcgacggguuccagaacaagaaaugggaucuguucguagaacgcagcaaagcguauuccaacugcuacccauacgacguacccgacuacgcaucacuccgcucccuugucgccucaaguggaacacuagaguucaacaacgaaucauucaacuggaccggagucacccaaaacggcacauccuccgcaugcaucagacgauccucauccucauucuucagccgacugaacuggcuaacgcaccugaacuacaaauaccccgcccugaacgucacaaugcccaacaacgaacaauucgacaaacuauacaucuggggcguacaccacccuggcacagacaaagaccaaaucuucccauacgcgcaauccuccggaagaaucaucgucuccaccaaacgcucccaacaagcaguaaucccuaacaucggcucccgcccacguauccgagacucuccaagccgcaucagcauauacuggacaauugucaaaccaggcgacauacucuuaaucaacagcacaggaaaccucauugcgccccgcggcuacuucaaaauucgcuccggaaaaagcagcaucaugcgcuccgacgcccccaucggcaaaugcaaauccgaaugcaucaccccaaacggcagcauacccaacgacaaaccauuccaaaacgucaaccgaauaaccuacggcgccugcccccgcuacgucaaacacucaacacucaaacucgccaccggcaugcgaaacguccccgaaaaacagacgcgaggaauauucggcgccaucgccggcuucaucgaaaacggcugggaaggcauggucgacggcugguacgguuucagacaccaaaacuccgaaggacgagggcaagcagccgaccucaaauccacccaagccgcuaucgaccaaauaaauggcaaacuaaaccgacucaucggcaaaacaaacgaaaaauuccaccaaaucgaaaaagaguucucugaaguggaaggacgaauccaggaccucgaaaaauacgucgaagacaccaaaaucgaccucugguccuacaacgccgaacuccuggucgcccuagaaaaccaacacaccaucgaccucaccgacuccgaaaugaacaaacucuucgagaaaaccaagaaacagcugcgcgaaaacgccgaagacaugggaaacggcugcuucaaaaucuaucacaaaugcgacaacgccugcaucggaagcauacgcaacggaaccuaugaccacaacgucuaccgcgacgaagcgcuuaacaaccgcuuccagaucaaaggcguagaacuaaaauccggcuacaaggacuggauccucuggauauccuucgccauuuccugcuuccuccucugcgucgcccuccuaggcuucaucaugugggcaugccagaaaggaaacauccgaugcaauaucugcaucuaa

SEQ ID NO: 215751 - RNA, 1701 nt, Artificial Sequence
  derived and/or modified sequence opt from Influenza A H3N2 hemagglutinin
augaaaacgaucaucgcgcuauccuacauccucugccuaguuuucgcccaaaagauccccggcaacgacaacaacacagccacacucugccuuggccaccacgccgucccgaauggcacaaucguaaaaaccaucacgaacgaccggaucgaggucaccaacgccacagaacucguacaaaacucauccauaggcgaaauaugcgacucaccacaccaaauacucgacggagagaacugcacacucaucgacgcccuccugggcgacccccaaugcgacggguuccaaaacaagaaaugggaccuauucguagaaagaagcaaggccuacucuaacugcuaccccuacgacgucccagacuacgccucacuccgcagccucgucgcaucaagcggcacccuggaguucaacaacgaaucauucaacuggaccggagucacccaaaacggaaccagcucagccuguauccgacgaucuucuagcagcuucuucucccgccucaacuggcucacacaccuaaacuacaaguaccccgcccucaacguaaccaugccaaacaacgaacaauucgacaaacucuacauauggggcguacaccacccaggcacugacaaagaccaaaucuuccccuacgcucaaucaagcggcagaaucacagucuccaccaaacggagccaacaagccgucaucccaaacauuggcagccgcccacgcauacgcggaauacccucccgcaucuccaucuacuggaccauaguaaaacccggagacauccuccucaucaacuccaccggcaaccucauagcaccacgcggcuacuucaaaauccguuccggcaaaagcucaaucaugcgauccgacgcgccaaucggcaaaugcaaauccgaaugcaucacccccaacggaucaauccccaacgacaaaccauuccagaaugucaaccgcauaaccuacggcgccugcccccgauacgucaagcacucaacccugaaacucgcaaccggaaugcgcaacguccccgaaaaacaaacccgcggcaucuucggagccaucgcgggauucaucgaaaacggcugggaaggcauggucgacggcugguacggcuuccgccaccagaacuccgaaggccgaggacaagccgccgaccucaaauccacgcaagcagccaucgaccaaaucaacggcaaauuaaacagacuaaucggcaaaacaaacgaaaaauuccaccagaucgaaaaagaguucucagaaguagaaggcagaauccaagaccuagaaaaauacgucgaagacaccaaaaucgaccuauggucauacaacgccgagcugcuagucgcgcuagaaaaccaacacaccauagaccucaccgacuccgaaaugaacaaacucuucgagaaaaccaaaaagcagcuccgcgaaaacgccgaagacaugggcaacggcugcuucaaaaucuaccacaaaugcgacaacgcaugcauagaaagcauccgcaacggcacauacgaucacaacguauauagagacgaagcacucaacaaccgauuccaaaucaaagggguagaacuaaaauccgguuacaaggacuggauccucuggaucuccuucgccaucucaugcuuccuacucugcguagcccuccuaggauucauaaugugggccugccagaaaggaaacauacgaugcaacaucugcaucuaa

SEQ ID NO: 215752 - RNA, 1701 nt, Artificial Sequence
  derived and/or modified sequence opt from Influenza A H3N2 hemagglutinin
augaaaaccaucaucgcccucucguauauccucugccucgucuucgcccaaaaacuuccaggcaacgacaauuccaccgccacacuuugucuaggccaccacgccguccccaacgguacaaucgucaaaacaaucaccaacgaccgcaucgaaguaacgaaugccaccgaauuaguccagaacucgagcauaggugaaauaugcgacagcccgcaccaaauccucgacggcgaaaacugcacccucauugacgcccugcucggagacccccaaugcgacggcuuccagaacaagaaaugggaccucuucgucgaacgguccaaagcauacuccaacugcuaccccuacgacgugccagacuacgccucccuccgcucacuggucgccagcuccgggacacucgaguucaacaacgaaucauucaacugggccggcguaacccaaaacggcaccuccucagcaugcauccgcggaagcaacagcuccuucuucagccgccucaacuggcucacccaccucaacuucaaauaccccgcacuaaacgugaccaugcccaacaacgaacaauucgacaaacucuacaucuggggaguccaccacccuggcaccgacaaagaccaaauauucuuguacgcccaaucuaguggccgcaucacaguaagcacaaaaagaagccaacaagccgucauacccaacauaggaagcagaccacgcauacgcaacauccccucgagaauaucgaucuacuggaccauagucaaacccggagacauacuccugaucaacagcacaggcaaucucauagcaccccgaggcuacuucaaaauacgcucaggaaaaagcucaaucaugcgcucggacgcccccaucggaaaaugcaaaagcgaaugcauaacccccaacggcucaauccccaacgacaaaccauuucaaaacgucaaccgaauaaccuacggagcaugcccccgcuacgucaaacaauccacccuaaaacucgcuaccggaaugcgaaacguuccagaaaaacaaacacgcggcaucuucggcgccaucgccggauucaucgaaaacgggugggaaggcaugguagacggaugguacggcuucagacaccaaaacuccgaaggccgcggccaagcagccgaccugaaauccacacaagcggccaucgaccaaaucaacggcaaacucaaccgccucauaggcaaaacaaacgaaaaauuccaccagaucgagaaagaguucucagaaguagaaggccgcauacaagaccucgaaaaauacgucgaagacaccaaaauagaccuaugguccuacaacgccgagcuucugguagcccucgaaaaccagcacacaaucgaucuaaccgacagcgaaaugaacaaacucuucgagaaaaccaagaaacaacuccgcgaaaacgccgaagacaugggcaacggaugcuucaaaaucuaccacaaaugcgacaacgccugcaucggcagcauccgcaacggcaccuacgaccacgaugucuacagagacgaagcauuaaacaaccgauuucaaauaaaaggaguagaacucaaaucaggcuacaaagacuggauccucuggauauccuucgcaauuucaugcuuccuacucugugucgcccuccucggauucauaaugugggccugccaaaaaggaaacauacgaugcaacaucugcauuuaa

SEQ ID NO: 215753 - RNA, 1701 nt, Artificial Sequence
  derived and/or modified sequence opt from Influenza A H3N2 hemagglutinin
augaaaacaaucaucgcccuauccuacauccucugccucguauucgcccaaaaacuucccggcaacgacaacagcacugccacgcuaugccuagggcaccacgcugugcccaacggcacaaucguaaaaacaaucacgaacgaccgcaucgaagucacaaacgcaaccgaacugguccagaacuccucuauaggagaaauaugcgacucaccucaccaaauccuagacggcgagaacugcacccucaucgacgcccuacucggcgacccccaaugcgacgguuuccaaaacaagaaaugggaccucuucgucgaacgaucaaaggccuacagcaacugcuaccccuacgacgugcccgauuacgccucccuccggucacucgucgccagcuccggaacacucgaguucaacaacgaaucauucaacugggccggcguaacccaaaacggcaccuccuccgcaugcaaacgcggguccaacucaucauucuucagccgccucaacuggcucacacaccucaacuucaaauacccagcacucaacgucaccaugcccaacaacgaacaguucgacaaacuauacaucugggguguccaccacccaggaaccgacaaagaccaaaucuucccauacgcacaauccagcggccggauaaccguauccacaaaacggagccaacaagcagucauccccaacaucggaucccggcccagaauccgaaacauacccuccagaauaagcauuuacuggaccaucgucaaacccggagauauccuucuuaucaacuccaccggaaaccucaucgcaccccgcggguacuucaaaauacgaucaggcaaguccuccaucaugcgaagcgacgccccuaucgguaaaugcaagagcgaauguaucacccccaacgguagcauccccaacgacaaaccauuccaaaacgucaaucgaaucaccuacggcgccugccccagauacgucaaacaauccacccucaaacucgcaaccggcaugcgaaacguccccgaaaaacaaacccgaggcaucuucggcgccaucgccggauucaucgaaaacgggugggaaggaauggucgacggcugguacggcuuccgacaccaaaacagcgaaggccgaggucaagccgccgaucucaaaagcacgcaagccgcaauagaccaaaucaacggaaaacucaaccgacucaucggcaaaacuaacgaaaaauuccaccaaaucgaaaaagaguucucagaagucgaaggaagaauccaagaccucgagaaauacgucgaagacacaaaaauagaucucuggucauacaacgccgaacuccuagucgcacucgaaaaccaacacaccaucgaccucaccgacucagaaaugaacaaacucuucgagaaaaccaagaaacaacuccgagagaacgcagaagacaugggcaacggauguuucaagauuuaccacaagugcgacaacgcaugcauaggauccauccgaaauggcaccuacgaccacgacguauacagagacgaagcgcuaaacaaccgauuccaaauaaaaggagucgagcucaaguccggcuacaaagacuggauacuauggauauccuucgccauaucuugcuuccuacuaugcgucgcacucuugggauucauaaugugggccugccagaaaggcaacauacgaugcaacaucugcauauaa

SEQ ID NO: 215754 - RNA, 1701 nt, Artificial Sequence
  derived and/or modified sequence opt from Influenza A H3N2 hemagglutinin
augaaaaccaucaucgcccucuccuacauacucugccucgucuuugcacaaaaacuacccggcaaugacaauuccacagccacacugugccuaggucaccacgccguccccaacggcaccauagucaaaaccaucaccaacgaucgcaucgaagucaccaacgccaccgaacucguccaaaauagcuccaucggagaaauaugcgacaguccccaccaaauacuagacggagaaaacugcacccuaaucgacgcacuccucggagacccccaaugcgacggauuccagaacaagaaaugggaccuguucgucgaaagauccaaagccuacagcaacugcuaucccuacgacgucccagacuacgccucacuccgcucgcucguagcauccagcggcacacucgaguucaacaacgaaucguucaacugggccgguguaacccaaaacggaaccuccuccagcugcauacgcggcucgaacagcagcuucuucucccgacucaacuggcucacccaccucaacagcaaauacccggcccucaacguaacaaugccaaacaacgaacaauucgacaaacuuuacaucuggggaguccaccaccccggcaccgacaaagaucagaucuuccucuacgcccaauccucuggacgcauaacugucuccaccaagagaucucaacaagcaguuauccccaacauuggaucacgcccccggauccgcgacaucccaucccgcaucuccauauacuggacaauaguaaagcccggagacauccuccucauaaacucaaccggaaaccucauugcuccccgaggauacuucaaaauccgcuccggcaaauccagcaucaugcgcuccgacgcccccaucggaaaaugcaaauccgaaugcaucaccccaaacggcuccauccccaacgacaaacccuuccaaaacgucaaccgaaucacauacggggccugcccccgcuacgucaaacaaagcacucuaaaacuugccacagguaugcgcaacguacccgaacgucaaacccgcggcaucuucggugccauagccggcuucauagaaaaugggugggaaggaauggucgacggcugguacgguuuccgacaccagaacucagaaggacgcggccaagccgccgaccucaaaagcacacaagccgccauagaccaaauaaacggcaaacucaaccgccuaaucgguaaaacaaacgagaaauuccaccaaauugagaaagaauuuucagaagucgagggaagaauccaagaccuugaaaaauacgucgaagacaccaaaauagaccucugguccuacaacgcagaacuccuuguagcacuagaaaaccaacacacgaucgaccucaccgacagcgagaugaacaaacucuuugagaaaaccaagaaacaacuacgcgaaaacgccgaagacaugggcaacggcugcuucaaaaucuaccacaaaugcgacaacgccugcaucggcuccaucagaaacggaaccuacgaccacgacgucuaccgcgacgaagcccuaaacaaccgcuuccaaaucaaaggaguugaacuaaaaagcggcuacaaagacuggauacucuggauauccuucgccaucucaugcuuccuacuaugcgucgcccuacuaggcuucauaaugugggccugucagaaaggcaacauccgcugcaacaucugcaucuga

SEQ ID NO: 215755 - RNA, 1701 nt, Artificial Sequence
  derived and/or modified sequence opt from Influenza A H3N2 hemagglutinin
augaaaacaaucauagcacuaucuuacauccuaugccucguuuucgcccaaaagauacccggcaacgacaacucaaccgccacgcuaugccucggacaccacgcuguacccaacggcaccaucgucaaaacuauuaccaacgaccggaucgaagugacaaacgccaccgaacuuguccagaacucaagcauaggcgaaauuugcgacucaccccaccaaauccucgacggugaaaacuguacccuaaucgacgcccuccucggcgacccacaaugcgacggcuuccagaacaagaaaugggaccuauucguagagcgaagcaaagccuacagcaacugcuaccccuacgacgucccggauuacgcaucacuacgaucccuaguugccuccuccggaacacucgaguucaacaacgaauccuucaacuggaccggcgucacacaaaacggcacaucgucagcaugcauacgaagauccucaagcucauucuucuccaggcuaaauuggcugacccaccuuaacuacacauaccccgcacuaaacgucaccaugcccaacaacgagcaauucgacaaacucuacauuuggggcguacaccacccuggcaccgacaaagaccaaauauuccuauacgcccaaucaagcggccgaaucaccguauccacaaaacggagccaacaggcagucaucccaaacaucggcagcagaccccgcauccgcgacaucccaucccgcaucagcaucuacuggaccauaguaaagcccggagacauccuccuaaucaacagcaccggcaaccucaucgccccgcgcggauacuucaaaauacguuccggcaaaagcuccaucaugcgauccgacgcccccaucgguaaaugcaaauccgaaugcaucacacccaacggcagcaucccaaacgacaaacccuuccaaaacgucaaccggauaaccuauggagccugcccacgauacgucaaacacuccacucucaaacuggcaacggguaugcgcaacguacccgaaaagcaaacacgcggaaucuucggagcaauagcaggcuucaucgaaaacgguugggaaggcauggucgacggcugguacggcuucaggcaccaaaacucagaggggcgaggccaagccgccgaucucaaauccacccaggccgcaauugaccaaaucaacggcaaacuaaacagacucaucggaaaaacuaacgagaaauuccaccaaauagaaaaggaguucuccgaagucgaaggacgcauucaagaccucgaaaaauacgucgaagacaccaagauugaccucuggucauacaacgcagaacuacuugucgcccuagaaaaccaacacaccauagaccucaccgacuccgaaaugaacaaacucuucgaaaagaccaagaaacaacuucgcgaaaacgccgaagauaugggcaacgguugcuucaaaauauaccauaagugcgacaacgccugcaucggcucuauccgcaacggcaccuacgaccacaacgucuaccgagacgaagcacucaauaaccgcuuccaaauuaaaggagucgaacucaaauccggauacaaggacuggauccuauggaucagcuucgccauaucauguuuccugcucugugucgcucuccugggauucaucaugugggcaugccagaaaggcaacauccgcugcaacaucugcauauaa

SEQ ID NO: 215756 - RNA, 1701 nt, Artificial Sequence
  derived and/or modified sequence opt from Influenza A H3N2 hemagglutinin
augaaaacaaucaucgcgcucuccuacauccuuugccucgucuucgcacagaaaauaccagggaacgacaacagcaccgccacgcuuugccuaggccaccacgccgucccaaacggcaccauugucaagaccauaacaaaugaccguaucgaagugacuaacgccacagaacucguacagaacuccaguaucggcgaaauaugcgacagcccccaccaaauauuagacggagaaaacugcacacugauugacgcacuccucggcgacccccaaugcgacggauuccaaaacaagaaaugggaccuuuucguagaacgcagcaaagccuacuccaacugcuaucccuacgacguaccagacuacgccucccuccgcucccuugucgccucaucaggaacacucgaguucaacaacgaauccuucaacuggaccggcgucacacaaaacggcaccagcuccgccugcauccgccgaucuucguccucauucuuuucccgccucaacuggcucacccaccucaacuacaaauacccugcccuaaacguaaccaugcccaacaaugaacaguucgacaaacucuacaucuggggcguucaccaccccggaaccgacaaagaccaaauauucccuuacgcacaauccucaggccgcauaaucguaagcaccaaacgcucccaacaagcagucauacccaacaucggcucgcgaccacgcauccgcgacauccccucccgaaucucaauuuacuggaccauagucaaacccggcgacauccuccucaucaacucaaccggaaaccuuaucgcgccccgcggcuacuucaaaauccgaucaggaaaauccucaauaaugcgcucugacgcccccaucggcaaaugcaaaagcgagugcaucacccccaacggauccauccccaacgacaagccuuuccaaaacguuaaccgcauaacguacggcgccugcccccgcuacguuaaacacucgacgcuaaaacucgccaccggaaugcgcaacgugcccgaaaaacagacacgagggaucuucggcgccaucgcaggcuucaucgaaaacggcugggaaggcauggucgacggcugguauggcuuccgccaccagaacagcgaaggacgcggacaggccgccgaccucaaauccacacaagcagcgaucgaccaaaucaacggcaaacucaaccgauuaaucggcaaaaccaacgaaaaauuccaccagaucgaaaaggaguucagcgaaguagaaggacgcauccaggaccucgaaaaauacgucgaagacaccaaaaucgaccuuuggucauauaacgcagaacuacucgucgcacuagaaaaccaacacacaauagaccucaccgacuccgaaaugaacaaacuuuucgaaaagacuaagaaacagcucagagaaaacgcagaagacaugggcaacggcugcuucaaaaucuaccauaaaugcgacaacgccugcaucggcuccauaagaaauggcaccuaugaccacaacgucuaccgcgacgaagcccuaaacaaccgcuuccaaaucaaaggcgucgaacucaaaagcggcuacaaagacuggauccuuuggauauccuucgccaucuccugcuuccuacucugcgucgcccuccucgguuuuaucaugugggccugccaaaaagggaacauccgcugcaacaucugcauauaa

SEQ ID NO: 215757 - RNA, 1701 nt, Artificial Sequence
  derived and/or modified sequence opt from Influenza A H3N2 hemagglutinin
augaagacaauaaucgcgcucucguacauccucugccuagucuucgcacaaaagcuacccggcaacgacaacucaaccgccacccuaugccucgggcaccacgccguacccaacggaaccauagugaaaacaaucaccaacgaccgcaucgaagucaccaacgccacagaacucguacagaacucauccaucggcgaaaucugcgauagcccccaucagauacucgacggcgaaaacugcacccugaucgacgcacuacugggagacccgcaaugcgacggcuuccagaacaagaaaugggaccucuucgucgaacgcagcaaagccuacuccaacuguuauccauacgacgucccugacuacgccucccuccgcucccuuguggccuccuccggaacucuagaauuuaacaacgaauccuucaacugggccggcguaacucaaaacggaaccuccagcuccugcauccgcggcagcaacagcagcuucuuuagccggcuaaacuggcugacccaccucaacucaaaauacccagcacuuaacgucaccaugccaaacaacgaacaauucgacaagcucuacaucuggggcguccaccacccagguaccgacaaagaccaaaucuuccuguacgcccaauccagcggccgcauaaccgucagcacgcgacgcagccaacaagccgucauacccaacaucggaucccgcccccgaauccgcgacauccccucccgcaucagcauauacuggacaaucgucaaacccggagacauccuccuaaucaacuccaccggcaaccucauagcuccgcgcggauacuucaaaauccgcuccggcaaauccuccaucaugcgcagcgacgcccccaucggcaaaugcaaaagcgagugcaucacaccaaacggcuccauccccaacgacaaacccuuccaaaacgucaaccgcaucacuuacggcgcgugcccccgauacgucaaacaaucaacccucaaacuugcaaccggcaugcgcaacgucccggaacgccaaacacgcggcauauucggcgcgaucgccggcuucaucgaaaacggcugggagggcauggucgauggcugguauggcuucagacaccaaaacuccgaaggacguggacaagccgccgaccuaaaguccacccaagcagccaucgaccaaauaaacggcaagcuaaaccgccuaaucgguaaaaccaacgagaaauuccaccaaaucgagaaggaguucuccgaaguggaaggacgcauccaagaccuagaaaaauacguagaagacaccaaaauagacuuauggagcuacaacgcagaacuucuaguagcccucgaaaaucaacacacaaucgaucuaacagacucagaaaugaacaaacucuucgagaaaaccaagaaacagcuccgagaaaacgccgaagacaugggcaacggcugcuucaaaaucuaccacaaaugugacaacgccugcauaggcuccauccgaaacggcacuuacgaccacgacguauaccgagacgaagcacucaacaaccguuuucaaauaaaagggguagaacucaaaagcggguacaaagacuggauccuauggauauccuucgccaucagcugcuuccuccucugcgucgcacuacucggauuuauaaugugggccugccaaaaaggaaauauacgcugcaacauaugcaucuga

SEQ ID NO: 215758 - RNA, 1701 nt, Artificial Sequence
  derived and/or modified sequence opt from Influenza A H3N2 hemagglutinin
augaaaaccauaauugcccucuccuacauccuaugucucgucuucgcacaaaaacuacccggcaaugacaacucgaccgccacacucugccugggccaucacgccguacccaacggcaccaucgugaagaccaucaccaacgaccgaauagaagucaccaacgccacggaacucgugcagaacucuuccauaggagaaaucugcgacucaccacaccagauccucgacggcgaaaacugcacccucaucgacgccuugcuaggcgacccccaaugcgauggcuuccaaaacaagaaaugggaccucuucgucgaacgcuccaaagcauacuccaacugcuaccccuacgacguccccgauuacgccucccuucgcucccugguagcuucauccggcacccuagaguucaacaaugaaucauucaauugggccggagucacacaaaacgggaccuccuccuccugcauacgcggaagcaauaacuccuucuucucacgccucaacuggcucacgcaccugaauagcaaauaccccgcccucaacgugaccaugcccaacaacgaacaauucgacaaacuauacauauggggcgugcaccaccccggcacagacaaagaccaaaucuuccuauacgcacaauccuccggccgcaucaccguaagcacacgccgaucccagcaagccgucauccccaacaucggaucucggccccgcaucagaggaaucccaucuagaauauccaucuacuggaccauaguaaaaccaggggacauacuccucaucaacuccaccggaaaccucaucgcaccccgagguuacuucaaaauacgauccggcaaauccucgaucaugcgcuccgacgcccccaucggcaaaugcaaaagcgaaugcaucacccccaacggcuccauccccaacgacaaaccauuccaaaaugucaaccgaauaacauacggcgccugcccccgauacgucaagcagucaacccucaaacucgcaaccgguaugcgaaacguccccgaacgccaaaccagaggaauauucggcgcaauagccggcuucauagaaaacggaugggaaggcauggucgacggcugguacggcuuccgccaccaaaauucagaaggacgcggucaagcggcagaccucaaguccacacaagccgcaauagaccaaauaaacggaaagcucaauagauuaaucggcaagaccaacgaaaaauuccaccaaauagaaaaagaguucucagaagucgaaggacgcauacaagaccuagagaaauacguagaagacaccaaaauagaccucuggucguacaacgcagaacugcucgucgcccucgaaaaccaacacaccaucgaucuaaccgauagcgaaaugaacaaacucuuugaaaagacuaagaaacaacuccgcgaaaacgccgaagacaugggaaacggcugcuucaaaauauaccacaaaugcgacaacgcaugcauaggcuccauccggaacggaaccuacgaccacgacgucuaccgcgaugaagcccucaacaaccgcuuccaaaucaaaggcgucgaacucaaauccggcuacaaagacuggauccucuggauauccuucgccaucuccugcuuccuacucugcguagcccuccucggcuucaucaugugggccugccaaaaaggcaacauccgaugcaacauuugcaucuaa

SEQ ID NO: 215759 - RNA, 1701 nt, Artificial Sequence
  derived and/or modified sequence opt from Influenza A H3N2 hemagglutinin
augaagacaauaaucgcccucucauacauccuaugccucgucuucgcacaaaaacuuccagguaacgauaacagcacagcaacacuaugccucggccaccacgcagucccaaacggaacaaucgucaaaacaauaaccaacgaccguaucgaaguaacaaacgcaacggaacucguacaaaacuccagcaucggcgagaucugcgacucaccccaccaaauccucgacggagaaaacugcacccucaucgaugcccuucucggagacccacaaugcgacggguuccaaaacaagaagugggaccucuucgucgaacgcuccaaagcauacuccaacugcuacccauacgacgucccagacuacgcauccuuacgcucccucguggccagcagcggaacacucgaguucaacaacgaaucauucaacugggcaggcgucacccaaaacggaaccucuuccuccugcauaagaggauccaacuccucguucuucuccaggcuuaacuggcucaccaggcucaacucuaaauaccccgcccuaaacguaacaaugcccaacaacgaacaauucgauaagcucuacaucuggggcguacaccaccccgaaacagauaaagaccaaauauuccuauacgcacaauccucaggccgcaucaccgucagcacccgcagaagccaacaagcagucaucccaaacauaggaaguagaccccgcauccgcggcauaccaucacgcauaagcauauauuggaccaucgucaaacccggggacauccuccucauaaacucuacaggcaaccucaucgcaccacgcggcuacuucaaaaucagaucgggaaaauccuccaucaugcgcucagacgcccccaucggcaaaugcaaguccgaaugcaucacccccaacgguuccauaccgaacgacaagcccuuccaaaacgucaacagaaucacauacggagccugcccccgcuacgucaaacaauccacccucaaacucgcuacaggcaugcgaaacgucccagaacgacaaacacgcggcaucuucggcgcaaucgccggauucaucgaaaacggaugggaaggcauggucgacggcugguacggauuccgccaccaaaacucugaaggaagagggcaagccgcagaccuuaagagcacccaagccgcaaucgaccaaaucaauggcaaacucaaccgacucaucggcaaaaccaacgaaaaauuccaccaaaucgagaaggaguucucggaaguggaaggccguauccaggaucuagaaaaauacgucgaagauacgaaaaucgaccucuggucauacaacgccgaacuccuagucgcacuagaaaaccaacacaccauagaccucaccgacucagaaaugaacaaacucuucgaaaagaccaaaaagcaacuccgcgagaacgccgaagacaugggcaacggcugcuucaaaaucuaccacaagugcgacaacgccugcauaggcucgauccggaacggcacauacgaccaugauguguaccgagacgaagcgcuaaacaaccgcuuccaaaucaaaggcguugaacucaaaagcggauacaaagacuggauccuauggaucuccuucgccaucuccugcuuccuacuaugcgucgcgcuccuuggcuucauaaugugggccugccagaaaggcaacauccgcuguaacauaugcaucuaa

SEQ ID NO: 215760 - RNA, 1701 nt, Artificial Sequence
  derived and/or modified sequence opt from Influenza A H3N2 hemagglutinin
augaaaaccaucaucgcacuuuccuacauacucugccucguuuucgcacaaaaacuccccggaaacgacaacagcacagcuacccucugccucggccaccacgccguacccaacggcaccauaguaaaaacaaucaccaacgaccgaauugaagucaccaacgccacagaacugguccaaaacucaagcaucggcgaaauaugcgacagcccccaccaaauacucgacggcgaaaacuguacgcucaucgacgcccuacucggagacccccaaugcgacggguuccaaaacaagaaaugggaccuguucguggaacgguccaaagccuacuccaauugcuaucccuacgacguaccugacuacgccagccuccguucgcucgucgccuccagcggcacccucgaguucaacaacgaauccuucaacugggccggcguaacccaaaacggcacauccuccuccugcauccgcggcagcaacaacuccuucuucagcagacuaaacuggcucacacaccucaacucaaaguaccccgcccuaaacgucaccaugccaaacaacgaacaauucgacaaacucuauaucuggggcguacaccacccagucacagacaaagaccaaauauuccuguaugcacaaucaagcggccgcaucaccguauccacccgacgcucccaacaagcaguaauccccaacauaggcagcagaccccgaauccgaggcauacccucacgcauaagcaucuacuggaccaucgucaagccaggcgacauacuacucaucaacuccaccggaaaccuaaucgccccgcgaggauacuucaaaauccgaucaggaaaaagcuccauaaugcgcuccgacgcccccauaggcaaaugcaaaagcgaaugcauaacccccaacggauccauccccaacgacaaacccuuccaaaacgucaaccgcaucaccuauggcgccugcccccguuacgucaaacaaagcacccucaaacuagcaacgggcaugcgcaacguccccgaaagacaaacgcgcgggaucuucggcgcgaucgccggcuucaucgaaaacggaugggaaggcauggucgacggcugguacggauuccgccaccaaaacuccgaaggacgcggccaagcggccgaccucaaauccacucaagccgccaucgaccagaucaaugguaaacucaaccggcugauuggcaaaacaaacgaaaaauuccaucagaucgaaaaagaguucagcgaagucgaaggacguauacaagaccucgagaaauacgucgaagacaccaagaucgaccugugguccuacaacgccgaacuacugguagcacucgaaaaccaacacacaaucgaccucacagacuccgagaugaauaaacucuucgagaaaaccaagaaacaacucagggaaaacgccgaagacaugggaaacggaugcuucaagaucuaccacaagugcgacaacgccugcaucggcuccaucagaaacggcacauacgaccacgacgucuaccgcgacgaagcacugaauaaucgcuuccaaaucaaaggcgucgaacuaaaaagcggauacaaagacuggauccucuggaucuccuucgcuauaagcugcuuucuccucugugucgcacugcugggcuucaucaugugggcaugccaaaaaggcaacauccguugcaacauaugcaucuag

SEQ ID NO: 215761 - RNA, 1701 nt, Artificial Sequence
  derived and/or modified sequence opt from Influenza A H3N2 hemagglutinin
augaagacaauaaucgcacucuccuacauacuaugucucgucuucgcucaaaaacuaccggguaacgacaacuccacagccacacucugccucggccaccacgcggucccaaacggaaccauagucaaaaccaucaccaacgauagaauagaaguaacaaacgccaccgagcuaguacaaaacuccuccaucggcgaaaucugcgacagcccccaccaaauacuagacggugaaaacugcacacuaauagaugcccuccucggagacccacaaugcgacggauuccagaauaagaaaugggaccuauucgucgagcgauccaaggcuuacuccaauugcuaccccuacgacgucccagacuacgccagccuccgcucucucguggcauccagcggaacccucgaguucaacaacgaauccuucaacugggccggagucacccaaaacggcaccuccuccagcugcauccgcggcuccaacagcuccuucuucucucgauuaaacuggcucacacaccucaacucaaaauaccccgcccucaacgucaccaugccaaacaacgaacaauucgacaaacuauacaucuggggcguccaucaccccggcaccgacaaagaccaaaucuuccucuacgcccaguccuccggcagaaucaccgucuccacaaaacgcagccaacaagccgucauccccaauauuggcuccagaccccggauccgcgacauacccucccgcaucuccaucuacuggaccauagucaaacccggugacauccuccuaaucaacuccacuggcaacuuaaucgcaccccgcggcuacuuuaaaauccgcucaggcaaaagcucuaucaugcgcuccgacgcaccgaucggcaaaugcaaauccgaaugcaucaccccaaacggaucaauccccaacgacaaacccuuccaaaacgucaaccgcaucaccuacggagcgugcccgcgauacguuaaacaauccacacucaaacucgccacaggaaugcguaacgucccagaaaaacagacccgaggcauauucggcgcaaucgccggauucauagaaaacggcugggaaggaauggucgacggcugguacggcuucaggcaccagaacuccgagggacguggccaagccgccgaccuaaaaucaacccaagccgcaaucgaucaaauaaacggaaaacugaaccgcuuaaucggcaaaaccaacgaaaaguuccaccaaauugagaaagaguucucagaagucgaaggaagaauacaagaccucgaaaaguacgucgaagacaccaaaaucgaccuguggucauacaacgcugagcuccucgucgcccuagagaaccaacacaccauugaccuaaccgacucagaaaugaacaagcuauuugagaaaacaaagaaacaacucagagaaaacgcagaagacaugggcaacggcugcuucaaaaucuaccacaaaugcgacaacgcaugcaucggcagcauucgaaacggcaccuacgaccacgacguauacagagacgaggcccugaacaaccgguuccaaaucaaaggagucgaacuaaaaagcggauacaaggacuggauacucuggauauccuucgcaaucucaugcuuccuccucugcgucgcacuucucggcuucaucaugugggccugccaaaaaggaaacauccgaugcaacaucugcaucuaa

SEQ ID NO: 215762 - RNA, 1701 nt, Artificial Sequence
  derived and/or modified sequence opt from Influenza A H3N2 hemagglutinin
augaagacuaucaucgcccucucauacauccucugccucguauucgcacaaaaacuaccaggcaacgacaacagcaccgccacgcucugccuaggccaucacgccgugccaaacggcaccaucguaaaaaccaucacaaacgaccgcauagaagucacaaacgcaacagagcuaguccaaaacuccuccaucggcgaaauaugcgacucgccccaccaaauacuagacggcgaaaacugcacccucaucgacgcccuacuaggcgacccacaaugcgacgguuuccaaaacaaaaagugggaccucuucgucgaacgcucaaaagccuacagcaacugcuacccauacgacguacccgacuacgccagccuacgcucucucgucgccucguccggcacccucgaauuuaacaacgaauccuucaacugggccggcgucacccaaaacggaaccucgucuucaugcauacgcggcagcaacagcucauucuucagcagacucaacuggcuaacccaccucaacuucaaauaccccgcacugaacgucacaaugcccaacaacgagcaauuugacaaacucuacauauggggcguacaccaccccggaacggacaaagaccaaauauuccuguacgcccagucauccggccgcaucacugucagcacaaaacgcucacaacaggccgucauacccaacaucggcagcagaccccgcauacgcgacauacccucucgaauaagcauauacuggaccaucgucaaacccggcgacauccuccuuauuaacagcaccgguaaccuaauugccccgcgcggcuacuucaaaauccgaucgggaaagagcuccaucaugcgcucagacgcccccaucggaaaaugcaagucagaaugcauaacacccaacggauccauacccaacgacaaaccuuuccaaaacgucaaucgcaucaccuacggcgcgugcccacgauacgucaaacaaucaacccuaaaacuagcaaccggcaugcgcaacguucccgaaaaacaaaccagaggcaucuucggcgccaucgccggcuucaucgaaaacggcugggagggaauggucgacggcugguacggauuccgucaccagaacuccgaaggccgaggacaggccgccgaccucaaauccacccaagccgccauugaccagaucaacggaaaacucaaccgccuaaucggcaaaaccaacgaaaaauuccaccaaaucgaaaaagaguucuccgaaguagaaggccgcauccaagaccucgaaaaauacgucgaagacacaaaaauagaccuuuggucguacaacgccgaacuccucguugcccuggaaaaucaacacaccauagaccuaaccgacucggagaugaacaaacuauucgagaaaaccaagaaacaacuacgcgaaaaugccgaagacaugggcaacggcuguuucaaaaucuaucacaaaugcgacaacgccugcauaggcucgauccgcaauggcacuuacgaccaugacguauaccgagacgaagcacuaaacaaccgauuccagaucaaaggcgucgaacuaaaauccggcuacaaagacuggauacucuggaucucuuucgcaauauccugcuuccuacucugcguugcccuccuaggcuucaucaugugggcaugccaaaaagguaacaucagaugcaacaucugcaucuaa

SEQ ID NO: 215763 - RNA, 1701 nt, Artificial Sequence
  derived and/or modified sequence opt from Influenza A H3N2 hemagglutinin
augaagaccaucaucgcacucucuuacauccucugccuagucuucgcacaaaaacuacccggcaacgacaacagcaccgcaacccuaugccucggacaccacgccguccccaacggaacacucgucaaaacaaucacaaacgaccagaucgaagucaccaacgccacagaacucguccaauccucgucgaccggaagaauaugcgacuccccacaccgcauccuagacggcaaaaacugcacgcuaaucgacgcccuccucggggacccacacugcgacggcuuccaaaacaaagaaugggaccuguucaucgaacgcagcaaggccuacuccaacugcuacccauacgacgugccagacuacucaucccuccgaagccuaguagccucgucaggcacccuagaguuuacaaacgaagacuucaauuggacaggcguggcccaagacggcggcucauacucaugcaaacgagagagcgucaaaucuuucuuuagccgacucaacuggcuccacaagcuagaauacaaauaccccgcacucaacgucaccaugcccaacaacgacaaauucgacaaacuauacauauggggcgugcaccaccccucaacagacuccgagcaaaccucccucuacguccaagcaauaggacgcguaacagucucaaccaaaagcagccagcaaaccgucauacccaacauaggaagcaggccauggguccggggcaucagcagccgaaucagcauauacuggaccauaguaaaacccggggacauccuccuaaucucgucuaccggcaaccucaucgcacccagaggauacuucaaaauacgaaacggcaaaucaucaauuaugcgaucagacgcccccauagacaacugcuacuccgaaugcauaacaccgaacggcucuauaccuaacgacaaacccuuccaaaacgucaaccgcaucaccuacggcgcaugccccaaauacguaaaacaaaagacccuuaaacuggccaccggaaugcgaaacgucccggagaaacaaacacggggaaucuucggcgcaaucgccggauucaucgagaacggcugggaaggcaugguagacggcugguacggcuucagacaccaaaacuccgaaggcaccggccaagcugccgaccucaaaagcacucaagccgccauagaccagguaaacggcaaacuaaaccgccugauagagaaaaccaacgaaaaguuccaccaaaucgaaaaagaguucucagaaguggaagggagaauccaagaccucgaaaaguacgucgaagacaccaaaauagaccucuggucauacaaugccgaacuccuagucgcacuagaaaaccaacacaccaucgaccuuacagacuccgaaaugaacaaacuguucgaaaagacccgaaaacaacuccgugaaaacgcagaagacaugggcaacgguugcuucaaaaucuaucacaagugcgacaacgcaugcaucggcuccauucgaaacgggaccuaugaccacgacgucuacagggacgaagcccuaaacaaccgcuuccaaauaaaaggcguugaacuaaaguccggauacaaagacuggauccucuggauaucauuugccaucuccugcuuccuacucugcgucguccuccucggauucaucaugugggccugccaaaagggcaacauacgcugcaacaucugcaucuaa

SEQ ID NO: 215764 - RNA, 1701 nt, Artificial Sequence
  derived and/or modified sequence opt from Influenza A H3N2 hemagglutinin
augaaaaccauaaucgcacuguccuauauacuaugccucgucuucgcccaaaagcucccagguaacgacaacagcacagccacccucugucucggccaccacgcagucccaaacggcacaaucguaaaaaccaucaccaacgaccgaaucgaagucaccaacgccaccgaacucguccaaaacucaucgaucggcgagaucugcgacuccccacaucaaauccucgauggcgaaaacugcacacugaucgacgcgcuucucggcgacccccaaugcgacggcuuccaaaacaagaaaugggaccuguucgucgagcgaucaaaggccuacuccaauugcuaccccuacgacguacccgacuacgccagccuccgcagccucgucgccucauccggaacacuagaguucaacaacgaauccuucaacugggcaggcgucacccaaaacggcacauccuccuccugcauacgcggcagcaacagcucauucuucucccgacucaacuggcucacccaccuaaacuccaaauaccccgcccugaacguaaccaugcccaacaacgaacaauucgacaaacucuacauauggggcguccaccauccaggcacagacaaagaccaaaucuuccuauacgcacaauccuccggacguauaaccguauccacgaaacggucccaacaagccgucauucccaacauagggucccgaccacgcauuagagacaucccaucccgaaucuccaucuacuggacaauagucaaaccuggcgacauccuacugaucaacagcacaggcaaccucauugcaccccgcggcuacuucaaaauccgcuccggaaaaucuucaaucaugagguccgacgccccaaucggaaaaugcaaaagcgaaugcaucaccccgaacggcucaauccccaacgacaagcccuuccaaaacgucaacagaaucaccuacggagccugcccgcgcuacguaaaacaauccacacucaaacucgcaacaggcaugcgaaacguccccgaacggcaaacccgcggcauauucggagccaucgcaggcuucaucgaaaacggaugggaaggcauggucgacggcugguacggcuuucgacaccaaaacucagaaggccgcggacaagccgccgaccucaaaagcacccaagccgcaauagaccaaauaaacggcaagcuaaaccgccucaucgguaaaaccaacgaaaaauuccaccaaaucgaaaaagaguucuccgaagucgaaggccgcauccaagaccucgagaaguacguagaagacaccaaaauagaccucuggucauacaacgccgaacuccuaguagcccuagaaaaccagcauacaaucgaccucaccgacucagaaaugaacaaacucuucgagaaaaccaagaaacaacucagagaaaaugccgaagacaugggcaauggaugcuucaaaaucuaccauaaaugcgacaacgccugcauaggcagcauacgaaacggaaccuacgaccacgacgucuacagagacgaagcccuaaacaauagauuccaaaucaaaggaguagaacucaaaagcggcuacaaagacuggauccuauggaucagcuucgccaucagcuguuuccuacuaugcgucgcccuccuaggauuuaucaugugggccugccaaaaagggaacauccgcugcaacaucugcaucuga

SEQ ID NO: 215765 - RNA, 1701 nt, Artificial Sequence
  derived and/or modified sequence opt from Influenza A H3N2 hemagglutinin
augaaaaccaucaucgcacucucauacauccuaugccucgucuucgcccaaaaacuccccggcaacgacaacuccaccgcaacacucugccucggccaccacgccguccccaacggcaccaucguaaaaacaaucaccaacgaccgcaucgaagucaccaacgccaccgaacucguccaaaacucauccauaggugaaaucugugacucaccccaccaaauacucgacggcgaaaacugcacccucaucgacgcccuccucggugacccucaaugugacggcuuccagaacaagaaaugggaccuguucguugaacgcagcaaagccuacuccaauugcuaccccuaugacgucccagacuacgcaucccugcgcucccucgucgccuccuccggcacccucgaguucaacaacgaaucauucaacugggccggagucacccaaaacggcaccagcuccuccugccgccgcggcucaaacagcuccuuuuucucacgccucaacuggcucacacaccuaaacaguaaauaccccgcacucaacgucaccaugcccaacaacgaacaauuugacaaauuauauaucuggggagugcaccauccagucaccgacaaggaccaaaucuuccuuuacgcccaaucgucaggaagaaucaccguguccacaaaacgcagccaacaagcaguuaucccuaacaucggaucccgcccccgcauccgcgauauccccucacgaaucucaaucuacuggaccaucgucaaacccggggacauccuccucaucaauucaacagggaaccuaauagcgccccgcggcuacuucaaaauccgcuccggcaaauccuccauaaugcgcucagacgcccccaucggcaaaugcaaauccgaaugcaucaccccaaacggauccauccccaacgacaagcccuuucaaaaugucaaccgcaucaccuacggcgccugcccccgauacguaaaacaaucaacccuuaaacuagccaccggcaugcguaacguaccagaacgacaaacccgcggaaucuuuggcgccauagccggcuuuaucgaaaacggcugggaaggcauggucgacggcugguacggcuuccgccaccaaaacuccgaagggcgcggccaagcagccgaccuaaaaagcacgcaagccgcaauagaccaaaucaauggcaaacucaaccgccucaucggcaaaaccaacgaaaaauuccaccaaauagagaaagaguucucagaagucgaaggccgcauccaagaucucgaaaaauacgucgaggacacaaaaaucgaccuauggucauacaacgccgaacuccuagucgcccucgagaaccaacacacuaucgaccuaaccgacucggagaugaacaaacuauucgaaaagaccaagaaacaacuccgcgaaaacgcagaagacaugggcaauggcugcuucaaaaucuaccacaaaugcgacaacgcaugcauaggaucaauccgcaacggaaccuacgaccaugacgucuaccgagacgaggcccuaaacaaccgcuuccaaauaaaaggagucgagcuaaaguccggcuacaaagacuggauacucuggaucuccuucgccaucucuugcuuccuccucugcgucgcccuccucggcuucaucaugugggccugccaaaaaggcaauauccgauguaacaucugcaucuaa

SEQ ID NO: 215766 - RNA, 1701 nt, Artificial Sequence
  derived and/or modified sequence opt from Influenza A H3N2 hemagglutinin
augaagaccaucaucgcacucucguacauccucugccucgucuucgcgcaaaaacuuccuggcaacgacaauucaaccgccacccuaugccuuggccaccacgcaguaccuaacggcaccauagugaaaacaaucacuaacgaccgaauagaaguaaccaacgccaccgaacucgugcaaaacucguccaucggcgaaauuugcgacagcccccaccagauccucgacggagagaacugcaccuuaaucgacgcacugcuuggagacccacaaugugacggguuccagaacaagaaaugggaccucuucguugaacgcuccaaagccuacuccaacugcuaccccuacgauguacccgauuacgccucccuccgcucccuagucgcauccuccggaacacuggaauuuaacaacgaauccuucaacugggccggcgugacacaaaacgguaccuccagcuccugcauacgaggcucaaacuccucguuuuucucuagacucaacuggcuaacccaccucaacuccaaauaccccgcccucaacguaaccaugccaaacaacgaacaauucgacaaacucuacauuuggggaguccaccaccccggaaccgacaaagaccaaaucuuccuauacgcccaaucuuccggcagaaucaccgucuccaccaaacgcagccagcaagccgucauccccaacaucggcuccagaccccggauccgggacauccccucacgcaucuccauauacuggaccaucgucaaacccggcgacauucuccucauaaacuccaccgguaaccucaucgccccacgaggcuacuucaaaauacgauccggaaaguccucgauaaugcgcuccgacgccccaaucggaaaaugcaaaagcgaauguauaaccccaaacggcuccauaccaaaugacaaaccguuccaaaacgucaaucgaauaaccuacggcgcaugcccaagauacgucaaacaguccaccuuaaaacuggccaccggcaugcgcaaugucccagaacgccaaacacgcggcauauucggcgcgaucgccgguuucaucgagaacggcugggaaggaauggucgauggcugguacggcuuccgacaccaaaacuccgaaggccgaggccaagccgccgaccucaaauccacgcaagcagcaauagaccaaaucaacggcaaacucaaccgccugauuggcaaaacgaacgaaaaauuccaccaaaucgagaaagaguucuccgaaguagaaggacgaauccaagaucucgagaaauaugucgaggacacaaaaauagaccucugguccuacaacgccgagcuccuuguggcacuagaaaaccaacacaccaucgaccuaaccgacucugaaaugaacaaacuauucgaaaagacuaagaaacaacucagagaaaacgcugaagacaugggcaacggaugcuucaaaaucuaccacaaaugcgacaacgcaugcaucggcuccauccgcaauggcaccuaugaccacgacgucuaccgcgacgaggcccuuaacaaccgcuuccaaauaaaaggagucgaacucaagagcggcuacaaagacuggauccuauggaucagcuucgccaucagcugcuuccuucucugcgucgcacuccuaggauucaucaugugggcaugccaaaaaggcaacauccguugcaacaucugcaucuaa

SEQ ID NO: 215767 - RNA, 1701 nt, Artificial Sequence
  derived and/or modified sequence opt from Influenza A H3N2 hemagglutinin
augaaaaccaucaucgcccucagcuacauccuaugcuuagucuuugcccaaaaacuacccggcaacgacaacuccaccgccacacucugucucggacaccacgcaguccccaacggcaccaucguaaaaaccaucaccaacgaccggaucgaagucaccaacgccaccgaacugguccaaaacucguccaucggggagaucugcgauucaccccaccaaauccuagacggcgagaacugcacacuaaucgaugcacuacucggagacccccaaugcgacggcuuccaaaacaagaaaugggaccucuucgucgaaagaagcaaagccuacagcaacugcuaucccuacgacguacccgacuacgccucacuacgcagccuaguggcguccagcggcacgcuagaguucaauaacgaauccuucaacugggccggagugacccagaacggaacaagcagcucaugcagacgcggcuccaacuccuccuucuucucccgacuaaacuggcuaacucgacucaacuccaaauaccccgcccuaaacgucaccaugcccaauaacgagcaguuugacaaacucuauaucuggggcguacaccaccccgucacagauaaagaccaaaucuuccuauacgcccaaucaagcggaagaauaaccgucuccacaaaacgcucacaacaagcagucauccccaauaucggaucccggccacgcauccgcgacauccccagccgcaucagcaucuacuggaccaucguaaaacccggcgacauucuccucaucaacucaacgggcaaccuaaucgcuccccgcggauacuucaaaaucagguccgguaaaucaagcauaaugcgauccgacgcgcccauaggcaaaugcaaaagcgagugcaucacccccaacggcucaauccccaacgacaaaccauuccaaaacgucaacagaauaacauacggcgcuugccccagguacgucaaacaaagcacccuaaaacuggccaccggcaugcgaaacguacccgaacgccagacccgagggauauucggcgccaucgcaggcuucauagagaacggcugggaaggcauggucgacggaugguacggauucaggcaccaaaauucagaagggcgaggccaagcggccgaccuaaagagcacgcaagccgcaauagaccaaaucaacggaaaacucaaccgcuugauaggcaaaaccaacgaaaaauuccaccaaauagaaaaagaauuuuccgaggucgaaggccgcauccaagaccuagaaaaauacguugaagacacaaaaaucgaccucuggucauacaacgcagaacuccucgucgcccuagaaaaccaacacacaauagaccucaccgacagcgaaaugaacaaacuauucgagaaaacaaagaaacaacuccgggaaaacgccgaagacaugggcaacggcugcuucaaaaucuaccacaaaugcgacaacgcaugcaucggcuccaucagaaacggcaccuacgaccacgacgucuacagagacgaagcccuaaacaaccgcuuccagaucaaaggcgucgaacucaaaagcggcuacaaagacuggauacucuggauaucauucgccauaagcugcuuccuccuaugcgucgcacuacuugguuucauaaugugggccugccaaaaggggaauauacgcugcaacaucugcauauaa

SEQ ID NO: 215768 - RNA, 1701 nt, Artificial Sequence
  derived and/or modified sequence opt from Influenza A H3N2 hemagglutinin
augaaaaccaucauagcccucucauacauccucugccuaguauucgcccaaaaacucccaggcaacgacaacagcaccgccacacucugccuaggccaccacgccguacccaacggcaccauuguuaaaaccaucaccaacgaccggauagaagucaccaacgccacagagcuaguacagaacagcuccaucggcgaaauaugcgacucuccccaccaaauacuagacggcgaaaacuguacccuaaucgacgcccuccuaggcgauccccaaugcgauggcuuucaaaacaagaaaugggauuuguucgucgaacgcuccaaagcauacuccaacugcuacccguacgacgucccagacuacgccucccuacggucccuagucgcuucaagcggcacacuggaguucaacaacgaaucauucaacugggccggcgucacccaaaacggcacuucauccucgugcaggcgcggaucaaacuccuccuucuucagccgccucaacuggcuaacccaccuaaacaguaaauacccagcccugaacguaacaaugcccaacaaugaacaauucgacaagcucuacaucuggggcguccaccacccagucacagacaaagaucaaaucuuucuauaugcacaaagcuccggccgcaucaccgucagcacaaaaagaagccaacaagcaguaauacccaacaucggauaccggccccgaauacgcgacauccccucgcgcaucucaauauacuggaccauagucaaaccuggagacauccuccucaucaauuccacaggcaaccuaauugcaccacgaggcuacuucaaaauacgcuccggcaaaucuuccaucaugcgcucggacgcccccauuggcaaaugcaaaucagaaugcaucaccccaaacggaagcauccccaacgacaaaccauuccaaaacguuaaucgaaucacauacggcgcgugcccaagauacgucaaacaauccacccucaaacuagccaccggcaugcgcaacguccccgaaagacaaacccgcggaaucuucggcgccaucgcaggcuucauugaaaacggcugggaaggcauggucgacggcugguacggauuccgccaccaaaacucugaaggaagaggccaagcagccgaccuaaaauccacacaagcagccauagaccagaucaacggaaaacuaaaccgccucauuggcaaaaccaacgaaaaauuccaccaaaucgaaaaagaguucuccgaagucgaaggacgcauacaagaucuagaaaaauacgucgaagacaccaaaaucgaccugugguccuacaacgccgaacuacuggucgcacucgaaaaccaacacaccaucgaccucacggacucggaaaugaacaaacucuucgaaaagaccaagaaacaacuccgagaaaacgcugaagacaugggcaacggcugcuucaaaaucuaucacaaaugcgacaacgccugcaucggaucaauccgcaacgggaccuacgaccacgacgucuaccgcgacgaggcccuaaacaaccgauuccaaauaaaaggcgucgaacucaagagcggcuacaaggauuggauacucuggaucuccuucgccaucucaugcuuccuucuaugcguugcacuccuaggauucaucaugugggccugccaaaaaggcaacauacgcugcaacauaugcauauaa

SEQ ID NO: 215769 - RNA, 1701 nt, Artificial Sequence
  derived and/or modified sequence opt from Influenza A H3N2 hemagglutinin
augaaaaccauaauagcacuuuccuacauucucugccuaguauucgcacaaaaacuccccggcaaugacaauagcaccgccacccucugccucggacaccacgccguccccaacggaacaaucguuaaaacaaucacuaacgaccgcauagaagucaccaaugcaacagaacucguacaaaacuccagcaucggcgaaaucugcgacagcccccaccaaauacucgacggcgagaacugcacccucaucgacgcacuccucggcgacccccagugcgacggauuccagaacaagaaaugggaccuauucgucgaaagguccaaggcuuacucaaauugcuaccccuacgacguaccagacuacgcaagccugcgcucacucgucgccuccagcgggacucucgaguucaacaacgaauccuucaacugggccgguguuacacaaaacggcaccuccuccuccugccgccgcgguuccaacucauccuucuucucacgccucaacuggcuaacccaccuaaacagcaaauacccugcacuaaacgucaccaugcccaacaacgaacaauucgacaaacucuacauuuggggcguacaccaccccguuaccgacaaagaccaaauauucuuauacgcccagucauccggaagaaucaccgucagcaccaaacgcagccaacaagccguaauacccaauaucggcuuccgcccccguauccgcgacauacccucccgcauaucaauuuauuggacaauagucaaacccggagacauccuacuaaucaacuccaccggaaaucugaucgcaccccgcggcuacuucaaaauacgauccggcaaguccuccaucaugcgaagcgacgcccccaucggaaaaugcaaauccgaaugcaucacccccaacggcuccauucccaacgacaaacccuuccaaaacgucaaucggauaacauauggcgcgugcccccgcuacgucaaacaaucaacacucaaacuggccaccggaaugcgaaacgucccagaacgccaaacccgcggcaucuucggagccauagccggauucaucgaaaacggcugggaaggcauggucgacggcugguacggauuccgacaccaaaauucggaaggccgcggccaagccgccgaccucaaauccacccaagcugccauagaccaaauaaacggcaaguuaaaccgacucaucgguaaaaccaacgaaaaauuccaccaaaucgagaaagaguucucagaagucgaaggaagaauccaagaccuugaaaaauacgucgaagacaccaaaauugaccuauggucauacaacgccgaacuccuagucgcacucgagaaccaacacacuaucgaccucacagacucggaaaugaacaaacucuuugagaaaaccaagaaacaacuccgggaaaacgccgaagacaugggaaacggcugcuuuaaaaucuaccacaaaugcgacaaugcgugcaucggcuccauccggaacggcaccuaugaccacgacgucuaccgcgacgaggcccuaaacaaucgcuuccaaauaaaaggcguagaacuuaaaagcggcuacaaggacuggauccucuggauaucauucgccaucagcugcuuccucuuaugcgucgcccuccuaggcuucaucaugugggccugccaaaaaggcaacauccguugcaacaucugcauauaa

SEQ ID NO: 215770 - RNA, 1701 nt, Artificial Sequence
  derived and/or modified sequence opt from Influenza A H3N2 hemagglutinin
augaagaccauaaucgcccuaucauacauccucugccucguauucgcacaaaaacuacccggcaacgacaacuccaccgcaacacuaugccucggccaccacgccguccccaacggcacaaucgucaaaacgaucaccaacgaccgcaucgagguaacaaacgcaaccgaacugguucaaaauucauccaucggcgaaaucugcgacuccccacaccaaauccuagacggcgaaaacugcacccuaauagacgcccuacuaggagacccacaaugcgacggcuuccaaaacaagaaaugggaccuguucguagaaagaagcaaagccuacucaaacugcuacccauacgacgugcccgacuacgcaagccuccgcucccucguagcgucaaguggaacacucgaauuuaacaacgaauccuucaacuggaacggcgucacccagaacggcaccuccuccgcaugcauccgccgcagcaacaacucauucuucucucgccuaaacuggcuaacacaccucaacuucaaauacccugcccucaacgucaccaugcccaauaaugaacaauucgacaaacuauacauauggggaguccaccaccccggaaccgacaaagaccaaauuuuccuauacgcacagccaaguggacgcaucaccguguccacaaaaagaagccaacaagcagucauacccaacauaggcagccggccccgcaucaggaacauacccucccguaucuccauuuauuggaccaucguaaaaccaggagauauccuccuaaucaacuccaccggcaaccugauagccccgcgcggcuacuucaaaauccgauccggcaaaucauccauuaugcgcagcgaugcacccauuggcaaaugcaaauccgaaugcauaaccccaaacggaagcauacccaacgacaagccauuccaaaacgucaaccgaauaaccuacggagccugcccccgauacgucaagcaaucaacacucaaacucgcaacgggcaugcgcaaugucccggaaaagcaaacccgaggaauauucggcgccaucgccggcuucaucgaaaacggaugggaaggcaugguagacggcugguacggcuuccgacaccaaaacucugaaggacgcgggcaagcagcagaccucaaaagcacccaagccgccaucgaccaaaucaacggcaaacucaaccgcuuaaucggcaaaaccaacgaaaaauuccaccaaaucgaaaaagaguucuccgaaguggaaggccguauccaagaccucgaaaaauacgucgaagacacuaaaaucgaccucuggagcuacaacgccgaacuccucgucgcacuagaaaaccaacacacaaucgaccuaacagacuccgaaaugaacaaacucuucgagaaaacaaagaaacaacuccgggaaaacgccgaagauaugggcaacggcugcuucaaaaucuaccacaaaugcgacaacgcaugcauaggcuccauccgcaacggcacuuacgaccacgacgucuaccgcgacgaagcccugaacaaccguuuccaaaucaaaggcgucgaacuaaaguccggcuacaaagauuggauacucuggauaaguuucgccaucagcugcuuccuccuuugcgucgcccuacuaggcuuuauaaugugggcaugccaaaaaggaaacauccgcugcaacauaugcaucuag

SEQ ID NO: 215771 - RNA, 1701 nt, Artificial Sequence
  derived and/or modified sequence opt from Influenza A H3N2 hemagglutinin
augaaaacaauaaucgcgcucuccuacauacuaugccuagucuucgcccaaaaacuccccggcaacgacaauucaacagccacccuaugcuuagggcaccacgccguccccaacggcacaaucgucaagaccauuaccaacgaucgcaucgaagucaccaacgccacagaacucguccaaaacuccuccauaggcgaaaucugcgacucgccacaccaaauacucgacggcgaaaacugcacccugaucgacgcacuccucggggacccacaaugcgacggcuuccaaaacaagaaaugggaccucuucgucgaaagaagcaaagccuacuccaacugcuaccccuacgacgucccagauuacgccagccuccgcucgcuugucgccucgagugggacucuagaguucaacaacgaaucauucaacuggaacggcgucacacaaaacggcacaagcagcgcaugcauccgacgcagcaacaacucuuucuucagcagacucaacuggcuaacacaucucaacuucaaauaccccgcacucaacguaaccaugccuaacaacgaacaauucgacaaacucuacaucuggggcguacaccaccccgucaccgacaaagaccaaaucuuccuauacgcccagcccagcgggcgcauaaccguaagcaccaaaagaucccaacaggccguaauaccaaacaucggcuuccgcccacgcauccgaaacaucccaucccguaucagcaucuacuggacgaucgucaaacccggcgacauacuucuaaucaauuccaccggcaaccucaucgccccacgcggcuacuucaaaauacguuccggaaaaagcagcaucaugcggagugaugcccccauaggcaaaugcaaauccgaaugcaucacaccaaacggcuccauacccaacgacaaaccauuccaaaacguaaaccgcaucaccuacggcgcaugcccgcgcuacgucaaacaaagcacccuaaagcucgccaccggcaugcgcaacguacccgaaaagcagacccgcggcauauucggcgccaucgccggcuucauagaaaacggcugggaaggcauggucgacggaugguauggauucaggcaccagaacuccgaaggcagaggccaagccgcagaccucaagucaacgcaagcagccaucgaccaaaucaauggaaaacucaaccgacucaucggaaaaacuaacgaaaaauuccaccaaauagaaaaagaguucucagaagucgaaggccgcauacaagaccuagaaaaauacgucgaagacacgaagauagaccuauggucauacaacgccgaacuccuagucgcacuagaaaaccaacacaccaucgaccuaaccgacuccgaaaugaacaaacucuucgaaaagaccaagaaacaacucagagaaaacgccgaagacaugggaaacggcugcuucaaaauauaccacaaaugcgacaacgcaugcauaggcucaauuaggaacggaaccuacgaccacgacgucuaccgagacgaagcccucaacaacagauuccaaaucaaaggagucgaacuuaaaagcggauacaaagacuggauccuguggaucagcuucgccaucuccugcuucuugcuuugcgucgcccuacugggcuucaucaugugggcaugccaaaaagggaacauccgcugcaacaucuguaucuaa

SEQ ID NO: 215772 - RNA, 1701 nt, Artificial Sequence
  derived and/or modified sequence opt from Influenza A H3N2 hemagglutinin
augaaaacgaucaucgcacuauccuacauacuaugccucguauuugcccaaaaacuccccggcaacgacaacucaacagcuacacucugucucggccaccacgccgucccaaacggcacaaucgucaaaaccaucaccaacgaucggaucgaagugacaaacgccaccgaacucguacaaaacuccagcaucggagaaaucugcgacaguccccaccaaauucuagacggagaaaacugcacacucaucgaugcccuacuaggcgacccccagugcgacggauuccaaaacaagaaaugggaccuauucgucgaaagaagcaaagccuacucaaacugcuaccccuacgacguccccgacuacgcaagccucagaagccuaguggccagcucagguacccuggaguucaacaacgagagcuucaacuggaacggcgucacccaaaacggcaccucaagcgcaugcauccgccgcuccaacaacucauucuucucccgacugaauuggcuaacccaccucaacuucaaauacccagcccuaaaugucaccaugcccaacaaugaacaauucgauaaacucuacaucuggggcguccaccacccaguaaccgacaaagaccaaaucuuccuauacgcccaacccucgggacgcaucaccguaagcaccaagcggagccaacaagcaguaauccccaauauaggguuccgcccccgcauacgaaacaacccaagccggaucucaaucuacuggaccaucgucaaaccaggcgacauacuccucauuaauucuacaggcaaccucaucgccccacgcggcuacuucaaaauccgcuccggcaagagcucgauaaugcgcagcgacgccccaaucgguaaaugcaaauccgaaugcaucacgccgaacggcuccauacccaacgacaaacccuuccaaaacguaaaccgcaucacuuacggugcaugcccacgguacgucaaacagagcacgcucaaacuggccacuggcaugcguaacgucccagaaaaacaaacccggggcaucuucggcgccaucgccgguuuuaucgaaaacgggugggaaggaauggucgacggcugguacggauuccgccaccaaaacucggaaggccgcggccaagccgcagaccucaaaagcacacaagccgccauagaccagaucaacggaaagcucaaccgucuuauaggcgaaaccaacgaaaaauuccaccaaauugaaaaagaguucagcgaagucgaaggccgcauccaagaccuugaaaaauacguagaagacaccaaaauagaccuauggucauacaacgccgaacuccucguggcccuagaaaaccaacacacaauagaccucaccgacucagaaaugaacaaacucuucgaaaagaccaagaaacaacuccgagaaaacgccgaagacaugggcaacggaugcuucaaaauauaccacaaaugcgacaacgcaugcauaggcagcauaagaaacggaacauacgaccacgaugucuaccgcgacgaagcacucaacaaccgauuccaaauaaaaggcgucgaacucaaauccggauacaaagacuggauacuauggaucucuuucgccaucagcugcuuucuccucugcgucgcgcuccuaggauucaucaugugggccugucaaaaaggcaacauccgaugcaacaucugcauauaa

SEQ ID NO: 215773 - RNA, 1701 nt, Artificial Sequence
  derived and/or modified sequence opt from Influenza A H3N2 hemagglutinin
augaaaaccaucaucgcccuauccuacauacucugccucguauucgcccaaaaacugccaggcaacgacaacagcaccgccacacucugccuuggacaccacgccgugccuaacggaacaaucgugaaaacaaucacaaacgaccgcauagaagucacaaacgccacagagcuaguacaaaacucaagcaucggcgaaaucugcgacagcccccaccaaauccucgacggcgaaaacugcacccucaucgacgcacuccucggcgacccucaaugcgacggauuccaaaacaagaaaugggaccuguucgucgaacgcuccaaggccuacuccaacugcuacccuuacgacguacccgacuacgcaucccuacgcucacucguagccagcuccggcacccuggaguucaacaaugaauccuucaacuggaacggcguaacccaaaacggcaccucauccgccugcauacggcgcagcaacaauuccuucuucucacgccuaaacuggcuaacccaccucaacuucaaauacccagcccuaaacgugaccaugccaaacaacgaacaauucgauaaacuauacaucuggggcguacaccaccccgucaccgacaaagaccaaauuuuccucuacgcccaacccuccggucgaauuaccguaagcacaaagcgcucccaacaagcagucauccccaauaucggcuuccgcccacgaauaagaaacaacccaucccgcauaucaaucuacuggacaaucguaaaacccggcgacauccuccuuaucaacagcaccggcaaucucaucgcaccccgcgguuacuucaagauccgaucaggcaaauccagcaucaugagaucagacgcccccaucggcaagugcaaaagcgaaugcaucacaccaaacggcuccauccccaacgacaaaccuuuccaaaacguaaaccgaauaacauacggcgccugcccccgcuacguaaaacaaucaacccugaaacuagccacuggcaugcgcaacguccccgaaaaacaaaccagagggauauucggcgccauugccggcuucaucgaaaacgggugggaaggcauggucgacggcugguacggauucagacaccaaaauuccgaaggcagagggcaagccgccgaccucaaaagcacgcaagccgccaucgaccaaauaaacggaaaacucaaucgacugauaggcaaaacgaacgaaaaauuccaccagauagaaaaagaguucagcgaagucgaaggccgcauccaagaccuagaaaaauacgucgaagacacgaaaauagaccugugguccuauaacgccgaacuccuugucgcacucgaaaaccagcacacaaucgaccucaccgacucggaaaugaacaaacuuuucgagaaaacaaagaaacaacuccgcgaaaaugccgaagacaugggcaacggcugcuucaaaaucuaucacaaaugcgacaacgcaugcauaggcuccauacgaaacgggacauacgaccacgacguauacagagacgaagcccuaaacaaccgcuuccaaauaaaagggguagaacuaaaauccggcuacaaggacuggauacuauggaucagcuucgccauuuccugcuucuuacuaugcgucgcccuccugggcuucaucaugugggcuugccagaaggggaacauccgcugcaauaucugcauauaa

SEQ ID NO: 215774 - RNA, 1701 nt, Artificial Sequence
  derived and/or modified sequence opt from Influenza A H3N2 hemagglutinin
augaaaaccauaauagcacucuccuacauccucugccucgucuucgcacaaaaacuccccggcaacgacaacucaaccgcaacccucugccugggccaccacgccguucccaacggaacaaucgucaaaaccaucacaaacgaccaaauagaaguaaccaacgccacagaacucguccaaagcucaucuaccggcgaaaucugcgacagcccccaccaaauccucgacggcgaaaacugcacccucaucgacgcccuccucggcgacccacagugcgacggcuuccaaaacaagaaaugggaccucuucgucgaaagaucaaaagccuacuccaacugcuaccccuacgacguacccgacuacgcgucccugcgcucacuuguagccucaagcggaacccucgaguucaacaacgaauccuucaacuggaccggcgucacccaaaacgggaccuccagcuccugcauacgcggauccaacaacuccuucuucucccgacucaauuggcuuacccaccucaaauucaaauaccccgcgcuaaacgucaccaugccaaacaacgagaaauucgacaaacucuacaucuggggcguccaccaccccgguacugacaacgaccaaauauucccauacgcccaggccuccggacgcaucaccgugucaacuaaacgaucccagcaaaccgucauuccaaacauaggaucccgaccccgcguacgcaacauccccucccgcaucagcaucuacuggaccauagucaaaccaggggacauccuacuaaucaacucaaccgguaacuuaaucgcaccccgcggguauuucaaaaucagaagcggaaaauccucuauaaugcgcuccgacgcccccaucggcaaaugcaacucagaaugcaucaccccaaacggcuccaucccaaacgacaaaccauuucaaaacguaaaccgcauaacguacggcgcaugcccccgcuacgucaagcaaaacacccucaaacucgccaccggaaugcgcaacguacccgaaaaacaaacacgaggcaucuucggcgccauagccggcuucaucgaaaacggcugggaaggcaugguagacggcugguacggcuuccgccaccaaaacuccgaaggcaucggccaagccgccgaucucaaauccacacaagccgcaauugaccaaauaaacggcaaacucaaccgacucauaggaaaaacaaacgaaaaauuccaccaaaucgaaaaagaguucucagaaguugaaggccggauacaagaccuagaaaaauacgucgaagacaccaaaauagaccucuggucauacaacgccgaacuccuggucgcucuggaaaaccaacacaccauagaccucacagacucugaaaugaacaaacucuucgaaaagaccaagaaacagcuccgugaaaacgccgaagacauggguaacggcugcuucaaaaucuaccacaaaugugacaacgccugcauaggguccauccgaaacggcaccuacgaccacgacgucuacagagaugaagcccucaacaaccgcuuccaaaucaaaggggucgaacucaaaucuggguacaaagacuggauacucuggauauccuucgccaucuccuguuuccuacuaugcgucgcgcuacuaggcuucaucaugugggcgugucagaaaggcaacaucagaugcaacaucugcaucuga

SEQ ID NO: 215775 - RNA, 1701 nt, Artificial Sequence
  derived and/or modified sequence opt from Influenza A H3N2 hemagglutinin
augaaaaccaucaucgcccuauccuacauccucugcuuagucuucgcccagaaaaucccaggaaacgacaacuccaccgccacccugugccucggccaccacgccguacccaacggcacgaucguaaaaaccaucaccaacgaccgcaucgaagucaccaaugccaccgaacucguccaaaacagcucgauaggcgaaauaugcgacuccccucaccaaauacucgacggcgaaaacugcacacugauagacgcccuccucggcgacccccaaugcgacggauuccaaaacaaaaagugggaccucuucgucgaacgcucaaaagccuacuccucaugcuaccccuacgaugugccagacuacgcuagccuccgcucccucguagcaucauccggcacccucgaguucaacaacgaauccuucaacuggaccggcgucacacaaaacggcaccuccuccgccugcauccgacgauccucguccuccuucuucucccgccugaacuggcucacccaucuaaacuauaaauacccagcucucaacgugaccaugcccaacaacgaacaauucgacaaacucuacaucuggggaguccaccaccccggcaccgacaaagaccagaucuucccauacgcgcaaagcuccggacgaaucaccgugagcacuaaacgaucacaacaagccgucauucccaacaucggaucacgaccccgcauacgcgacauccccucgcgcaucagcauuuacuggacaauaguaaaaccaggagacauucuccucaucaacucaacaggcaaccugauagccccucgaggauacuucaaaauccgaucuggcaaaucaucgaucaugcgaucugacgcacccaucggcaaaugcaaaucagaaugcauaacccccaacggcuccauacccaacgacaagcccuuccaaaacguaaaccgcauuaccuacggcgcaugcccccgauacgucaaacacagcacccuaaaacucgccacgggaaugcgcaacguccccgaaaaacaaacccgcggcauauucggagcaauagcaggauucauagaaaacggaugggaaggcauggucgacggaugguacggauuccgccaccaaaacucagaaggacgcggacaagccgccgaccuaaaauccacccaagccgcaaucgaccaaauaaacggcaagcuaaacagacucaucggcaaaaccaacgaaaaauuccaccaaaucgaaaaagaguucuccgaagucgaaggccgcauccaagaccucgaaaaauacgucgaagacaccaaaaucgaccuaugguccuacaacgccgaacuccugguagcacucgaaaaccaacacacaauagaccuaaccgacucagaaaugaacaaacuuuucgaaaagacaaagaaacaacuccgagaaaacgccgaagacaugggaaacggcugcuucaaaauauaccauaaaugcgacaacgcgugcaucggauccauccgcaacgguaccuacgaccacaaugucuaccgagacgaagccuugaacaaccgcuuccaaauaaagggaguugaacucaaaaguggcuacaaagacuggauccucuggaucuccuucgccauauccugcuuccuccugugcguggcacuacucggcuucauuaugugggccugccaaaagggcaacauacgcugcaacauauguaucuaa

SEQ ID NO: 215776 - RNA, 1710 nt, Artificial Sequence
  derived and/or modified sequence opt from Influenza A H3N2 hemagglutinin
augaaaaccaucaucgcccucagcuacauucucugccucgucuucgcacagaaaauccccggcaacgacaacuccaccgcaacccucugccuaggacaccacgccgucccaaacggcaccaucgucaaaacaaucaccaacgaccgcaucgaaguaacaaacgcaaccgaacucguccaaaacucauccauaggcgaaaucugcgacucgccccaccaaauucucgacggagaaaacugcacccuaaucgacgcgcuacucggagacccucaaugcgacggcuuccaaaacaagaaaugggaccuauucguggaacgguccaaagccuacagcaacugcuaccccuacgacguacccgacuacgccucccuccgcucccuaguagccuccuccggaacccucgaguucaacaacgaauccuucaacuggaccggcgucacacaaaacgggaccagcuccgccugcauccgaagauccagcagcucguucuucucaagacuaaacuggcugacccaccuaaacuacacuuauccggcacucaacgucaccaugcccaacaacgaacaauucgacaaacucuacauauggggaguccaccaccccggaaccgacaaagaccaaauauuccuuuacgcacaauccagcggacgcaucacaguauccaccaaacgaucccaacaagccguaauccccaacaucggcuccagaccaagaaucagagacaucccaucccgcauauccaucuacuggaccaucgucaaaccaggugacauucuccucauaaacucaaccggaaaccucaucgcaccacggggcuauuucaaaauacgcucaggcaaaagcucaaucaugcgcucagacgccccaaucggcaaaugcaaguccgaauguauaacacccaacggcuccaucccuaacgacaaacccuuucaaaaugucaaccgcaucaccuacggugccugcccccgguacguaaagcacuccacccucaaacuggccaccggaaugcgaaacguccccgaaaaacaaacccgaggaauauucggcgcaaucgcaggcuucaucgaaaacggaugggaaggcauggucgauggcugguacggauuccgccaccagaacuccgaaggacgcggccaagcagcagaucuaaaauccacucaagcugcaauagaccaaaucaacggcaagcucaaccgccugauaggaaaaacuaaugaaaaauuccaccaaaucgagaaagaguucucggaagucgaaggccgcauccaagaccucgaaaaauacguagaagacacaaaaauugaucucuggucguacaaugcagagcuucuagucgcccuagaaaaccaacacacaauagaccucacggacuccgaaaugaacaaacucuucgagaaaaccaagaaacaacuccgugaaaacgccgaagacaugggcaacggcugcuucaaaauauaccacaaaugcgacaacgccugcaucggaagcaucagaaacggcaccuacgaccacaacgucuaccgcgacgaagcccuuaacaaccgcuuccaaaucaaaggcguagagcucaaauccggauacaaagacuggauccucuggaucucauucgccauauccugcuuccugcucugugucgcccuacucggauucauaaugugggccugccaaaaaggaaacauccgcugcaacaucugcauauaaguccauuaa

SEQ ID NO: 215777 - RNA, 1701 nt, Artificial Sequence
  derived and/or modified sequence opt from Influenza A H3N2 hemagglutinin
augaaaaccauaauagcccuaucauacauccucugcuuagucuucgcacagaaaaucccaggcaacgacaacuccaccgcuacccucugccucggacaccacgccguaccaaacggcacaaucguaaaaaccauaacaaacgacagaauagaagucaccaacgccaccgagcuaguccaaaacuccuccaucggcgaaauaugcgacuccccacaccaaauacucgacggagaaaacugcacacucaucgacgcccuacucggcgacccccaaugcgacggcuuccaaaacaagaaaugggaccuauucgucgaacgcuccaaagccuauagcucauguuacccauacgacguacccgacuacgccagccuccgaucccucgucgccuccucugggacccucgaguucaacaacgaaucguucaacuggacaggcgucacccaaaacggaacaucaagcgcaugcauucgccgcuccucauccucguucuucucccgacuuaacuggcucacucaccuuaacuacaaauaccccgcccuaaacgucacuaugccgaacaacgaacaauucgacaaacucuacaucuggggcguacaccacccagggacagacaaagaccaaaucuuccccuacgcccaaucauccggccggauaaccgugagcaccaaacgcucccaacaagcaguaauaccuaacaucggaucccgaccccgcauucgcggaauccccucacgcaucuccauauacuggaccaucgucaaaccuggcgacauccuccucaucaacuccaccggaaaccuaaucgcuccccgcggguacuucaaaauacgcaguggcaaaaguagcaucaugcgaagcgacgccccaauaggcaaaugcaaaucagaaugcauaacaccaaauggcagcauccccaacgacaaaccauuccaaaacguaaaccgcauaaccuacggagccugcccuagauaugucaaacacucaacccucaaacucgccaccggcaugcgcaacgucccagaaaaacaaacucgcggcaucuucggagcaaucgcaggauucaucgaaaacggaugggaaggcauggucgacggaugguacgguuucagacaccaaaacucagaaggccgcggccaagccgcagacuuaaaaucuacacaagcagccauagaccaaauaaacggaaaacucaaccgucucaucggcaaaacaaacgaaaaauuccaccaaaucgaaaaagaauuuagcgaagucgaagggcggauccaagaccuugaaaaauacgucgaagauaccaaaaucgaccuauggagcuacaacgcagagcuccucgucgcccuagagaaccaacacaccaucgaccucaccgacucagaaaugaacaaauuauucgagaaaaccaaaaagcaacuccgcgaaaacgcggaagacaugggaaacggcugcuucaaaaucuaccacaaaugcgacaacgcaugcauaggcuccauccgcaacggcaccuacgaccacaacgucuacagagacgaagcccuaaacaaccgcuuccaaaucaaaggcgucgaacuaaaaagcggcuacaaagacuggauccucuggauauccuucgcuauauccugcuuccuacugugcgucgcccuccucggcuucaucaugugggcgugccagaaaggcaacauacgaugcaacauuugcaucuga

SEQ ID NO: 215778 - RNA, 1707 nt, Artificial Sequence
  derived and/or modified sequence opt from Influenza A H3N2 hemagglutinin
auggagaaaaucguccuacucuucgcaaucgucucacuugucaaaucagaccaaaucugcauuggcuaccaugccaacaacucaaccgaacaagucgacaccaucauggagaaaaacguaacagucacccacgcacaagacaucuuagagaaaacacacaacggcaaacucugcgaccuagacggcgucaaaccccuaauacugcgcgacugcucggucgccggguggcuccuuggcaaccccaugugcgacgaguucaucaacgucccggaaugguccuacauagucgaaaaagccaacccagucaacgaccucuguuaccccggagacuucaacgacuacgaggaacucaaacaccuccucagccgcaucaaccacuucgagaaaauccagaucauacccaaauccuccugguccucccacgaagccucacuuggcgucucaagcgcaugcccauaccagggcaaauccuccuucuuccguaacgucgucuggcuaauagagaaaaacagcacauaccccacuaucaaacgaagcuacaacaacacaaaccaagaagaccugcucguccucugggggauacaccacccaaacgacgccgcugaacaaacaaagcucuaccaaaacccaacaaccuacaucucaguaggcaccagcacccucaaccaacgccucgucccacgcaucgcaacccgcagcaaagucaacggccaaagcggaagaauggaguucuucuggaccauacucaagcccaacgacgcaaucaacuucgaaucaaacggcaacuucaucgcccccgaauacgccuacaaaaucgucaagaaaggcgauuccaccauaaugaaaagcgaacucgaauacgggaacugcaacacaaaaugccagacccccaugggcgccauaaauagcucgaugccauuccacaacauccacccccuaaccaucggggaaugccccaaauacguaaaaagcaacagacucguacuagccacaggacuacgaaacuccccacagcgcgaacgacgccgcaagaaaaggggccuauucggagccaucgccggcuucaucgaaggcggauggcaaggaauggucgacggcugguacgguuaucaccacaguaacgaacaagguucaggauacgcagccgacaaagaaagcacacaaaaagcgauagauggagucacaaacaaaguaaacaguauuauagacaaaaugaacacacaauucgaagccgucggcagagaauuuaacaaucuagaacgccgcauagaaaaccucaacaagaaaauggaagacggauuccuagacgucuggaccuacaacgccgaacuacugguccucauggaaaacgaaagaacacuagacuuccacgacuccaacgucaaaaaccuauacgacaaaguccgccuacaacuaagggacaacgccaaagaacucggcaacggcugcuucgaauuuuaccacaaaugcgacaacgaaugcauggaauccgugcgcaacggcaccuacgacuacccgcaauacuccgaagaagccagacucaaacgagaagagaucucaggcgucaaacuagaaucuaucggaaucuaccaaauacucuccaucuacuccacggucgcuagcucccuagcacucgcaaucaugguagcaggacuaucccuguggauguguagcaacggaucacuccaaugccgcaucugcauauaa

SEQ ID NO: 215779 - RNA, 1707 nt, Artificial Sequence
  derived and/or modified sequence opt from Influenza A H3N2 hemagglutinin
auggagaaaauaguccuacucuucgccaucgucucccucguaaaaucagaccaaaucugcaucggauaccacgccaauaacucaacggaacagguagacaccaucauggaaaaaaacgucacuguaacccacgcccaagacauucuagaaaaaacccacaacggcaaacuaugcgaccucgacggagucaaaccacuaauccuucgcgacugcucagucgccggguggcugcucggcaaccccaugugcgacgaauucauaaacguccccgaauggagcuacauaguagaaaaagccaacccaguuaacgaccucugcuaccccggagacuucaacgacuacgaagaauuaaaacaccuccuuucccgaaucaaccacuucgaaaaaauccaaaucaucccaaaaaguuccugguccucccacgaagccucacugggcgucucgagcgcgugccccuaccaagguaaaagcuccuucuuccgcaaugucguauggcucauaaaaaaaaacucaacauacccaaccaucaaacgauccuacaacaacaccaaccaagaagaccuccucguacuuuggggcauccaucaccccaaagacgcagccgaacaaaccaaacuauaccaaaacccuacaaccuacauaagcguuggcacuagcacacucaaccaacgucuagucccccgcaucgccacacgcuccaagguuaacgggcaaucaggcaggauggaauucuucuggaccauccugaaaccaaacgacgccauaaacuucgaguccaacggcaacuucaucgccccugaauaugcauacaaaaucgucaagaagggcgacagcacgaucaugaaaagcgaacucgaauacggaaacugcaacaccaaaugucaaaccccuaugggcgccaucaacagcucaaugcccuuccacaacauucacccacuaaccauaggcgaaugucccaaguacguaaaaucaaaccgacuuguccucgccacaggguuacguaauagcccccaacgcgaacgccgacgcaaaaaacgcgggcucuucggcgccaucgccggcuucaucgaaggcggauggcaaggaaugguagaugguugguacggauaccaccacuccaacgaacaaggcuccggcuacgcggcagacaaagaauccacccagaaagcaaucgacggcguaacaaacaaaguaaacuccaucaucgacaaaaugaacacccaauucgaagcaguaggaagagaauucaacaaccucgaacgccgcaucgagaaccucaacaagaaaauggaggacgguuuccucgacgucuggacauacaacgcagaacuacucguacucauggaaaacgaacgcacacucgacuuccaugacuccaaugucaaaaaccuguacgacaaaguacgccuccaacuccgcgacaacgccaaagagcucgguaacggcugcuucgaauucuaccacaaaugcgacaacgaaugcauggaaucaguccgaaacggaaccuacgacuauccccaauacucagaagaagcgcgccucaagcgagaggaaaucucgggagucaaacucgaaucaaucggcaucuaccaaauccuuuccaucuacuccaccguagcaagcucacuugcccuggccaucauggucgcaggacucucgcuguggaugugcaguaacggcucucuccagugccgcaucugcaucuaa

SEQ ID NO: 215780 - RNA, 1707 nt, Artificial Sequence
  derived and/or modified sequence opt from Influenza A H5N0 hemagglutinin
auggagaaaaucguccuacuccucgcgauagucucacuagugaaaagcgaccaaauaugcaucggauaccacgccaacaacagcacagaacaagucgacacgaucauggagaaaaacguaaccgucacgcacgcccaagacauccucgaaaaaacacacaacggcaaacucugcgaccucgacggugucaaaccccucauauuaagagacugcuccguagccggcuggcuccucggcaacccaaugugcgacgaguuucucaacgucccagaaugguccuacaucgucgaaaagaucaaccccgccaacgaccucugcuacccgggaaacuucaacgacuacgaagaacucaaacaccugcucucccgcaucaaccauuucgaaaaaauccaaaucauccccaaauccuccuggagcgaccacgaagccuccucaggugucuccuccgccugccccuaccaaggcagauccagcuucuucagaaacguaguauggcucaucaaaaaagacaacgccuaccccacaauaaaacgcucuuacaacaacaccaaccaagaagacuugcuugucuuauggggaauacaccacccaaacgacgcagccgaacaaacccgccuauaccaaaauccaaccaccuacaucuccguaggcaccucaacacucaaccaacgccuaguccccaaaauagccacacgcuccaaaguaaacggccaauccggucggauggaauucuucuggacaauacuaaagccaaacgacgcaaucaacuucgaaucaaacgggaacuucauagcgcccgaaaacgcauacaaaauaguaaaaaaaggagacagcaccauaaugaaaucagaacucgaauacgguaacugcaacacaaaaugccaaacccccauaggcgccaucaacuccuccaugcccuuccacaacauacacccacuuaccaucggcgaaugcccgaaguacgucaaauccaaccgacuaguccucgccaccggccuacggaacucaccacagggagaacgccgccgccgcaaacgcggccuauucggagcaauagccggcuucaucgaaggcggcuggcaaggcauggucgacggcugguacggcuaccaccacuccaacgaacagggcagcggcuaugccgcagauaaagaauccacgcaaaaagccaucgacggagucaccaacaaagucaacagcaucauagacaaaaugaacacacaauucgaggccgucggccgcgaauucaacaaccuagaacgccgaaucgaaaaccucaacaaaaaaauggaagacggauuucucgacgucuggacauacaacgcggaacuccuaguccucauggaaaacgaacgcacgcucgacuuccacgacagcaacgucaaaaaccucuacgacaaaguacgccuccaacucagagacaacgccaaagaacuaggcaacggcugcuucgaauucuaccacagaugcgauaacgaaugcauggaauccguacgaaacggaacauacgacuacccccaauacuccgaagaagcacgacuaaaacgcgaagaaauauccggaguaaaacucgaaagcauaggcaccuaccaaauacuuuccaucuacuccaccguggcuagcucgcucgcccucgccaucauggucgccggccuaucccucuggaugugcucaaacggaucccuccagugccgcaucuguaucuga

SEQ ID NO: 215781 - RNA, 1704 nt, Artificial Sequence
  derived and/or modified sequence opt from Influenza A H5N1 hemagglutinin
auggaaaagaucguacuccuauucgcaaccauaagccuagucaaauccgaccacaucugcauaggcuaccacgcaaacaacuccaccgaacaaguggacaccaucauggaaaagaacgucaccguaacccacgcccaggacauacuagaaaagacccacaacgguaaacucugcgaccucaacggagucaaaccccucauucucaaagacugcucagucgcaggauggcuucucgggaacccacucugcgacgaguucaccaauguaccggaaugguccuacauagucgaaaaagccaacccagccaacgaccugugcuaccccggaaacuucaacgacuaugaagaacucaaacaccuacucucacgcauaaaccacuucgagaaaauccaaauaaucccuaaagacagcuggagcgaucacgaagccagccuaggcgucucagccgccugcuccuaccaaggaaauuccuccuucuuccgcaacguagucuggcugaucaagaaagacaacgccuaccccaccaucaagaaaggcuacaacaacaccaaucgggaagaccuacuaauccuauggggcauacaccacccaaacgacgaagccgaacaaacaaaacuguaccaaaaccccacaacauacauuucuaucggcaccuccacccucaaccaacggcucguccccaaaauagccacacgcagcaaaauaaaccgccaaucaggccgaaucgacuucuucuggacaauccucaaacccaacgacgccauucacuucgaaagcaacggcaacuucaucgcccccgaauacgcuuacaaaaucguaaagaaaggcgacucaacaaucaugcgcuccgaagucgaauacggcaauugcaacacccgcugccaaacacccauaggugcaauaaacagcucgaugccauuccacaacauccacccacucaccauuggcgaaugcccuaaauacguaaaaucaaacaaacucguacucgcaacaggccuccgcaacucaccccaacgcgaacgccgccguaaaagaggcuuauucggcgcaaucgcaggauucaucgaaggaggcuggcaagguauggucgauggcugguacggauaccaccacucaaacgaacaaggaagcgguuacgccgccgacaaagaauccacccaaaaagccauagacggagucacuaacaaagucaacagcaucauagacaaaaugaauacccaauucgaggccguaggccgagaguucaacaaccuagaacgccgcaucgaaaaccuaaacaagaaaauggaagacggcuuccucgacgucuggaccuacaacgccgaauuacucguacucauggaaaacgaacgaacacuagauuuccacgacuccaacgucaaaaaccuauacgacaaaguccgccuccaacuaaaagacaacgcaaaagaacuaggaaacgggugcuucgaguucuaccacaaaugcaacaacgaaugcauggaaucaguacgcaacggaacauacgacuacccacaauacucggaagaagcccgccucaaacgcgaagaaaucagcggcgugaaacuagaauccaucggcauauaccagauccucagcaucuacuccacaguagcuucaucccucguccuagccaucaugauggccggccugucacuguggaugugcagcaacggcucccuccaaugccgaauaugcaucuga

SEQ ID NO: 215782 - RNA, 1695 nt, Artificial Sequence
  derived and/or modified sequence opt from Influenza A H5N1 hemagglutinin
auggagaaaaucguccuccuacuagccaucgucucacucgucaagucugaccaaaucugcaucggauaccacgccaacaauucaaccgaacaagucgauaccaucauggagaaaaacgugaccgucacccacgcccaagacauacucgagaaaacccauaacggcaaacuaugcgaccucgacggagucaagccacugauccuacgcgacugcuccgucgcaggcuggcuacucggcaacccaaugugcgacgaguuccugaacguccccgaaugguccuacaucgucgaaaagaucaacccagccaacgaccuaugcuaccccggcaacuucaacgacuacgaagaacucaaacaccuccucucgcgaaucaaccacuucgagaaaauccaaaucauccccaaaucauccugguccgaccacgaagcguccuccggggucucgucagccugcccauaccagggccgcagcucauucuuccgcaacgucguauggcucauaaagaaaaacaacgcuuaccccaccauaaaacgcaguuacaacaacacaaaccaagaagaccuacucguccuauggggaauacaccaccccaacgacgccgccgaacaaacacgccuuuaucaaaaucccaccacauacaucagcguaggcaccuccacccucaaccagcgccuaguccccaaaauagcaacccgaagcaaagucaacggccaauccggccgcauggaguucuucuggaccauccucaaacccaacgaugccauaaacuucgaauccaacggaaacuucauagcccccgaaaacgccuacaaaaucguaaagaaaggcgacuccaccaucaugaaaucagaacuagaauacggaaacugcaacaccaaaugccaaacacccauaggcgccaucaacuccagcaugcccuuccacaacauucacccucucacaauuggcgaaugccccaaauacgucaaaucuaacaggcucguccucgcaaccggccucagaaacagcccccaaauagaaacacgcggccuauucggcgcgauugccggauuuauagaaggcgguuggcaagggaugguugacggaugguacggcuaccaccacuccaacgaacagggcuccggcuacgcggcagacaaagaauccacccaaaaagccauagacggcgucacaaacaaagucaauuccauaaucgacaaaaugaacacccaauucgaagcagucggucgugaguucaacaaccucgaaagacgaaucgaaaaccugaacaagaaaauggaagauggcuuccucgacgucuggaccuacaacgccgaacuacucguccuaauggaaaacgaacgcacacucgacuuccacgacagcaacgucaaaaaccucuacgacaaaguacgucuccaacuccgcgacaacgccaaagaacucggcaacggcugcuucgaguucuaccacagaugcgauaacgaaugcauggaaagcguccgcaacggcaccuacgacuacccccaauacagcgaagaagcccgccuuaaacgcgaagagauaagcggcgugaaacuagaaagcaucgguacauaccaaauacucucuauauacagcacggucgcauccucacucgcccucgcaaucauggucgccggccucucccucuggaugugcucaaauggaucccuccaaugccgcaucugcaucuaa

SEQ ID NO: 215783 - RNA, 1707 nt, Artificial Sequence
  derived and/or modified sequence opt from Influenza A H5N1 hemagglutinin
auggaaaaaauaguacuccuguucgccaucaucucccuagucaagucagaccacaucugcaucggguaccacgccaacaacucaaccgaacaagucgacacaaucauggaaaaaaaugucacaguaacccacgcccaggacauacucgaaaaaacccacaacggaaaacuaugcgaccugaauggagucaagccccuaauccuaaaagacugcuccgucgccggcuggcuacucggaaaccccaugugcgacgaguucaucgacgucccugaauggucauacauagucgaaaaagccaaccccgccaacgaccuaugcuaccccggcaacuucaacgacuacgaagaacuaaaacaccuccuaucccgcaucaaccacuucgaaaaaauccgcaucauaccaaaagacagcuggcccgaccacgaagccucacucggcgucuccgcggcaugcucguaccagggaaacuccucauucuuccgcaacguugucuggcuccuaaaaaaagacaacgccuacccaaucauuaagaaauccuacaacaacaccaacaaagaagaccugcucguauuauggggcauacaccacccaaacgacgaagccgaacaaacccgccuauaccaaaaccccaccacuuacgucucaaucggcaccucaacacucaaccaacgacucgugccgcgcaucgccacacgauccaaagucaacggccaauccggccgaaucgacuucuucuggacuauccuuaagcccaacgacgcaaucaacuucgaaucaaacggcaacuucaucgcccccgaauacgccuacaaaaucgucaaaaaaggcgacuccaccaucaugcgauccgaagucgaguacggaaacugcaguacgcgcugccaaacacccaugggcgcaauaaacuccucaaugccauuccacaacauacacccccuaaccaucggagaaugccccaaauacgucaaaucaaacaaacuaguacucgccacaggacuacgcaacucuccccaaaucgaacgccgacgacgcaaacgaggccucuucggcgcaaucgcagguuucaucgaaggaggcuggcaagggauggucgacggcugguacggcuaccaccauuccaacgaacaaggaagcggcuacgcagcagacaaagaaagcacccagaaggccaucgacggcgugaccaacaaagucaacagcaucaucgacaaaaugaauacccaguucgaagccgucggcagagaauucaacaaccuagaacgacgcaucgagaaccucaacaaaaaaauggaagacggcuuccucgacgucuggaccuacaacgcagaacuccucguacucauggaaaaugaacgcacgcuagacuuccacgacagcaacguaaaaaaccuauaugacaaaguacggcuccaacuacgagacaacgccaaagaacucggcaacggcugcuucgaguucuaccacaaaugcgacaacgaaugcauggaaagcgugagaaacggcaccuacgacuacccucaauacagcgaagaagccagacucaaacgagaagagaucuccggcgucaaacuggaaucaauaggaacauaccaaauacucuccaucuacagcacugucgccuccucccucguccucgcuauaaugguagcaggacuaagccucuggaugugcagcaacggaucccuacaaugccgcauaugcaucuag

SEQ ID NO: 215784 - RNA, 1707 nt, Artificial Sequence
  derived and/or modified sequence opt from Influenza A H5N1 hemagglutinin
auggagaaaaucguccuccuguucgccaucaucagccuggugaaauccgaccacauaugcaucggguaccacgccaacaacuccacagaacaaguugacacaaucauggaaaagaacguaaccguaacccacgcccaggacauccucgaaaagacccacaacggaaaacuuugcgaccuaaacggaguaaaaccccucauccuaaaagacugcuccguggcaggcuggcuacucggcaaucccaugugcgacgaauuuaucgacguaccggaaugguccuacauagucgaaaaggcuaaccccgcaaacgaccucugcuaccccggcaacuucaacgacuacgaagaacucaagcaccuacugucgaggaucaaucacuucgaaaagauacgcaucauaccaaaagacucauggccagaccaugaagccucacucggggucagcgcagcaugcuccuaccaaggaaacagcagcuucuuccgcaacgucgucuggcugcugaagaaagacaacgccuacccaauuaucaagaaaucauacaacaacaccaacaaagaagaccuacuuguccucuggggcauccaccaccccaacgacgaagcugaacaaacacgccuauaccaaaaccccaccacauacgucucgaucggaaccuccacacucaaucaacgacucgucccccgcaucgccaccagaagcaaagucaacggccagagcggacgcaucgacuucuucuggacaauccucaaacccaacgacgccauaaauuucgaaagcaacggaaacuucaucgcuccagaauacgccuacaaaaucguaaagaaaggcgacucgacaauuaugcgaucagaaguagaauacggaaacugcagcacccgcugccagacacccaugggcgcaauaaacuccagcaugcccuuccacaacauacacccccuaaccaucggagaaugcccaaaauacguaaaaucgaacaaacucguccucgccaccggacuucgaaacagcccccaaaucgaaaggcgccgccgcaaacgaggccuguucggcgcgaucgccggcuucaucgaaggcggcuggcaaggaaugguagacggcugguacggcuaccaccacagcaacgaacaaggcagcggcuacgccgcugacaaagaaagcacucaaaaagccauagacggcguaaccaacaaaguaaacagcaucauagacaaaaugaacacccaguucgaagccguuggccgggaauuuaacaaccuagaacgccgaauagaaaaccuaaacaagaaaauggaagacggauuccucgacgucuggaccuacaacgcagaacuacucguccucauggaaaacgaacgaacacucgauuuccacgacagcaacgucaaaaaccuauacgacaaagucagacuccaacuccgcgacaacgccaaagaacugggaaauggaugcuucgaguucuaccacaaaugugacaacgaaugcauggaauccguacggaacggcaccuacgacuacccacaauacucagaagaagcccgccuaaaacgcgaagaaaucuccggcgucaaacuagaauccaucggaaccuaccaaauccuaagcaucuacagcacagucgccuccagccuuguacuagccaucauggucgccggccuaucccuguggaugugcuccaacggcagccuacaaugccgcaucugcaucuga

SEQ ID NO: 215785 - RNA, 1707 nt, Artificial Sequence
  derived and/or modified sequence opt from Influenza A H5N1 hemagglutinin
auggaaaagauaguccuccuauucgcgauagucucccucgucaaaucagaccaaaucugcaucggcuaccacgccaacaacuccacugaacaggucgacaccauaauggagaaaaacgucacaguuacccacgcccaagacauccucgagaaaacccacaacggaaaacucugcgaccuagacggcgucaaaccccucauacuacgcgacugcuccguagccggauggcuccucggcaacccaaugugugacgaguucaucaacgucccagaauggagcuacauagucgaaaaagcaaaccccgucaaugaccucugcuacccuggcgacuucaacgauuacgaagaacuaaaacaccuccucagccgcauaaaucauuucgaaaagauacagaucauccccaagucaucauggcccucucacgaagccucacucggcgucuccgccgcaugccccuaccaaggaaaauccagcuucuuccgaaacguaguauggcucauuaagaaaaacaacaccuaccccaccaucaaacgaucauauaacaacaccaaccaagaagaccuccuagugauguggggcauacaccaccccaacgacgcggccgaacaaaccaaccucuaucaaaaccccaccacauacaucuccgucggcacauccaccuuaaaccagcgccucacaccccgcaucgccacccgauccaaaguaaacggccagagcgggcgaauggaguucuucuggaccauacuaaaacccaacgacgccaucaacuucgaaucaaacggcaacuucauagcccccgaauacgcauacaaaaucguaaagaaaggcgacagcaccaucaugaaaucagaacucgaauauggcaacugcaacaccaaaugccagacacccaugggagcaaucaauucguccaugcccuuccacaacauccacccccucaccauaggggaaugcccaaaauacgucaagagcaaccgacucgucuuagccaccggccugcgcaacucaccccaacgagaagggcgacgcaagaaacgcggccuuuucggcgccaucgccggauucaucgaaggaggauggcaaggcaugguagauggaugguacggcuaccaccacagcaacgaacaaggcagcgguuacgccgccgacaaagaauccacacaaaaagccauugacggcguaaccaacaaaguaaacuccaucaucgacaaaaugaacacccaauucgaagccgucggcagagaguucaacaaccuagaaagacgaauagaaaaccuaaacaagaaaauggaagacggguuucuagacgucuggaccuacaacgcagaacuccucguccucauggaaaacgaacguacccuggacuuccacgacuccaacgugaaaaaccucuacgacaaaguccgccuccaacuaagagacaacgccaaagaacugggcaacgguugcuucgaguucuaccacaaaugcgacaacgaaugcauggaaucaguccgcaacgggacauaugacuacccccaauacagcgaagaagcccgacuaaaacgcgaagaaauauccggagucaaacucgaaagcaucggaauauaccaaauccucucaauauacuccacaguagccucaagccucgcccucgcaaucaugguagccggacuaucccuauggaugugcucaaacggaucccuccaaugccggaucugcaucuaa

SEQ ID NO: 215786 - RNA, 1707 nt, Artificial Sequence
  derived and/or modified sequence opt from Influenza A H5N1 hemagglutinin
auggagaaaaucguccuccucuucgcaaucgucucccuaguaaagagcgaccaaauuugcauaggcuaccacgcgaacaacagcaccgaacagguagacacgauaauggagaaaaacguaacagucacgcacgcccaggacauacuagaaaagacccacaacggaaagcucugcgaccucgacggcgucagaccacucauacucagagacugcagcguagccggcuggcuccucggcaacccaaugugugacgaguucaucaacguccccgaaugguccuacauugucgaaaaagccaacccagucaacgaccuaugcuaccccggagucuucaacgacuacgaagaauuaaaacaccuccucucaaggaucaaccacuucgagaaaauccaaaucauacccaaaaacucauggccaucacacgaagcaagccuaggcgucagcgccgccugcccauaucagggucaauccucauucuuccgcaacgucgucuggcucaucaagaagaacaacaccuaccccaccaucaaacgcagcuacaacaacacaaaccaagaagaccuccucgucauguggggaauacaccaccccaacgacgccguagaacaaacuaagcucuaccaaaacccaacgacuuacauaucaguaggcacauccacccucaaccaacgccuaaccccacgcaucgcuacacgaucaaaagucaaaggccucagcggcagaauggaauuuuucuggacaauuuuaaaacccaacgacgcaaucaacuuugaaucaaacggcaacuucaucgcgcccgaauacgccuacaaaaucgucaagaaaggcgacucuacaaucaugagauccgagcuggaauacggcaacugcaacaccaaaugccaaacccccaugggagccaucaacagcucaaugcccuuccacaacauccacccccucacuaucggugaaugccccaaauacguaaaaagcacgcgccuaguccucgcaaccggucuacgcaacagcccccaacgagaggaacgacgcaagaaacgcggucucuucggggcaauagccggcuucauagagggaggcuggcaaggaauggucgacggcugguacggcuaucaccacuccaacgagcaaggcagcggcuacgcugccgacaaagaaucaacacaaaaagccauugacggagucaccaacaaaguuaacagcaucauagacaaaaugaacacucaguucgaggcagucggccgcgaguucaacaaccucgaaagaagaaucgagaaccucaacaagaaaauggaagacggauucuuagacgucuggacauacaacgccgagcuccucguccugauggaaaacgaacgcacccucgacuuccacgacucgaacgucaaaaaccucuacgacaaaguacgccuccaacuccgcgacaaugccaaagaacugggcaacggaugcuucgaguucuaccacaagugcgacaacaaaugcauggaauccguacgcaacggcacauacgacuauccccaauacuccgaagaagcacgccucaaaagagaagaaaucagcggcguaaaacucgaaagcaucgguguauaccagauccucuccaucuacuccaccguagcgucgucccucgcacucgccaucaugguagccggccucagccucuggaugugcuccaacggcucccuacaaugccgcaucugcaucuag

SEQ ID NO: 215787 - RNA, 1707 nt, Artificial Sequence
  derived and/or modified sequence opt from Influenza A H5N1 hemagglutinin
auggagaaaauagugcuacugcucgccaucguaagccucgucaaaagcgaccaaauaugcaucggcuaccacgccaacaacagcaccgaacaggucgacaccauaauggagaaaaacgucaccgucacgcacgcgcaagacauccucgagaaaacacacaacggcaaacucugcgaccuagacggagucaaaccacucauacuacgagacugcagcguagcgggauggcuacucggcaacccgaugugcgacgaguuccuaaacgugccagaauggagcuacauaguagaaaagauaaaccccgccaacgaccugugcuacccaggaaauuucaacgacuacgaagaacugaaacaccuccucagccgcaucaaccacuucgagaaaauccaaaucauccccaaauccuccuggucggaccacgaagccagcucagguguuagcuccgccugccccuaccaaggccgaucgagcuucuucagaaacguagucuggcuaauaaagaaaaacgacgccuacccaaccaucaaaagaucauacaacaacaccaaccaagaagaccuacucguacuauggggcauacaccaccccaacgacgccgccgaacaaacacgccuuuaccaaaacccaaccaccuacauaucaguaggaaccucaacccugaaccaacggcuagucccaaaaaucgcuacccgaagcaaaguaaacgggcaaucaggacgaauggaauuuuucuggaccauccucaaacccaacgacgcaauaaacuucgaaagcaacggaaacuucaucgcccccgaaaacgccuacaaaaucgucaagaaaggggacucaacaaucaugaaaucagaacuugaauacggcaacugcaacacaaaaugccaaaccccaaucggagccaucaacuccuccaugcccuuccacaacauacacccgcucaccaucggagaaugcccgaaauacgucaaaagcaacagacucguacuagcgaccggacuacgaaacagcccacaaggcgaacgacgccgcaagaaacgaggccuauucggugccaucgcaggauucaucgaaggaggcuggcaaggcauggucgacggcugguacggcuaccaucacucaaacgaacaaggcaguggauacgcggcggacaaagaaagcacacaaaaagcaaucgacggcgucaccaacaaaguaaacuccaucaucgacaaaaugaacacccaguucgaagcagucggacgagaguucaacaaccuggaacgacgaauagaaaaccucaacaagaaaauggaagacggcuuccucgacgucuggacuuacaacgccgagcuucuugucuuaauggaaaaugaacgcacacuugacuuccacgauuccaacgucaaaaaccuguacgacaaagucagauuacagcuccgagacaaugcaaaagaacugggcaacgggugcuucgaguucuaccaccgcugugacaacgaaugcauggaauccguacgcaacggcaccuacgacuacccucaauauagcgaagaagcccgacucaaacgagaagaaaucucgggagucaaacucgaaagcaucggaaccuaccaaauccucuccauauacuccaccgucgcauccucacucgcccucgccaucauggucgcaggccugagccucuggaugugcagcaacggcucacuccaaugccgaauaugcauauaa

SEQ ID NO: 215788 - RNA, 1713 nt, Artificial Sequence
  derived and/or modified sequence opt from Influenza A H5N1 hemagglutinin
auggaaaagaucgucccacuccuagcaaucaucggccuagucaaaagugaccaaauaugcauaggauaucacgcgaauaacagcacagaacaagucgacaccauaauggaaaagaacguaaccgucacacacgcgcaagacauccuagaaaagacccacaacggaaaacuaugcaaccuagacggagugaaaccccucauccucaaagacugcuccgucgcaggauggcugcucggcaaccccaugugcgacgaguuccugaacgucagcgaaugguccuacauagucgaaaaagcaucccccgccaacggacuaugcuaccccggggauuucaacgacuacgaagaacuuaaacaccuccucaacagaaucacacaccuaaagaaaauaaaaauaauccccaaaaguuacuggucaaaccacgaagccagcuccggggucucagccgccugcagcuacaugggggaacccagcuucuuccggaacgucgucuggcucaucaagaaaaacaacacguacccacccauaaaagucaacuacaccaauacaaaccaagaagaccuccugguacucuggggcauucaccaccccaauaacgaagccgaacagauacaaaucuaccaaaaccuaauaacccacaucuccgucggaacgucaacgcucaaccaacgacuuauccccaaaaucgcgaccagaucaaaaguaaacggccagagcgggcgcauggaguucuucuggaccauccucaaacccaacgacagcaucaacuucgacucaaacggaaacuucaucgcgcccgaauacgcuuacauaguaaagaaaggugacuccgccauaaugaaaucagaacucgaauacggaaacugcaacacaaaaugccaaacucccaugggcgcaaucaacuccuccaugccguuccacaacauccacccccucaccaucggcgaaugccccaaauacgucaaaucaaaccgccuaguccuagcgaccggacuacgcaacgccccacaacgcgaacgcgaaggcggcagacggagaaaacggggacucuucggagcaaucgcaggauucaucgaaggcggcuggcagggaauggucgacggcugguacggauaccaccacucgaacgaacaagggucgggcuaugccgccgacaaagaaagcacccaaaaagcaaucgacggcaucacaaacaaaguaaacuccaucaucgacaaaaugaacacccaguucgaagcagucggccgcgaguucaacaaccucgaacgacgaaucgaaaaccucaacaagaaaauggaagacggcuuccucgacgucuggaccuacaacgccgaacuacucguucuaauggaaaacgaaagaacgcuagacuuucacgacucaaacgucaaaaaccucuacgaaaaaguacgccuccaacuacgagauaacgccaaagaacuuggaaacggcugcuucgaguucuaccacaaaugcgacaacgaaugcauggaaagcguccgcaacgggacauacgacuacucgcaauacagcgaagaagcccgccuaucacgcgaagaaauaaacggcguaaaacucgaaucaaugguaacauaccaaauacucucgauauacuccacagucgcuagcucauuggcacuagccaucauggucgcaggacuaucacuauggaugugcuccaauggcucccuccaaugccgaauaugcaucuaa

SEQ ID NO: 215789 - RNA, 1713 nt, Artificial Sequence
  derived and/or modified sequence opt from Influenza A H5N1 hemagglutinin
auggaaaagauaguacuccuccucgccaucaucucgcucgugaaaagcgaccaaaucugcaucggcuaccacgcaaacaacagcacagaacaaguagacaccauaauggaaaagaacguaacagucacccacgcacaagacauccucgagaaaacacacaacggcaaacuuugcaaccucgacggcguaaaaccguugauccucaaagacugcagcguggccggcuggcuacucgggaaccccaugugcgacgaguuccucaacgucagcgaaugguccuacaucguugaaaaagcaagcccggccaacggccuaugcuaccccggagacuucaacgacuacgaagaacugaaacaccuccucaaccgcauaacccaucucaagaaaauaaaaauaauccccaaauccuacuggucuaaccacgaagcaagcuccggagucucggccgccugcuccuacaugggggaaccuuccuucuucagaaacguggucuggcucauuaagaaaaauaacacauaucccccaaucaaagucaacuacaccaacacgaaccaggaagaccugcuaguccuauggggcauacaccaccccaacaacgaagccgaacagauacaaauauaccaaaaccuaauaacacacauauccgucggaaccucaacccuaaaccagagacuaaucccaaaaaucgccacccgguccaaaguaaacggacaaagcgggagaauggaguucuucuggaccauacucaaacccaacgacagcaucaacuucgacagcaacggaaacuucaucgcacccgaauacgcguacauagucaagaaaggagacuccgccaucaugaaaagcgaacuagaauacggcaacugcaacacaaaaugccaaaccccaaugggcgcaauuaacagcucaaugcccuuccacaacauacacccacucaccauaggagaaugccccaaauacgucaaaagcaaccgacugguccucgccaccggccuucgcaacgccccacagcgcgaacgugaaggaggcagaaggagaaaacgcggacucuucggagcgaucgccggcuucaucgaagggggcuggcaaggaauggucgacgguugguacggguaccaccacuccaacgaacagggaagcgguuacgcggccgacaaagaauccacccaaaaagccaucgacggaaucacaaacaaggucaacucaauuaucgacaaaaugaacacgcaauucgaagccgucggccgcgaguucaacaacuuagaaagacgcauagaaaaccuaaacaaaaagauggaagacggcuuccucgacgucuggacauacaacgccgaacugcuaguccuaauggaaaacgaaagaacacuagacuuccaugacuccaacgugaaaaaccuauacgaaaaaguccggcuacaacuacgagacaacgccaaagaacugggcaacggcugcuuugaguucuaccacaaaugcgacaacgaaugcauggaaagcguccgaaauggcaccuacgauuacucccaauacucagaagaagcccgccuaagccgagaagaaaucaacggagucaaacucgaaagcauggucacauaccagauccuaagcauauacuccaccgucgcaagcagccuagcacuagccauaauggucgccggacuaucgcuauggaugugcagcaacggaucccugcaaugccgcauaugcaucuaa

SEQ ID NO: 215790 - RNA, 1710 nt, Artificial Sequence
  derived and/or modified sequence opt from Influenza A H5N1 hemagglutinin
auggagaaaaucguccuccugcucgccaugauuggccuagucaaaagcgaccagaucugcauuggauaccaugccaacaacucgacagaacaagucgacaccaucauggagaaaaacgucacugugacacacgcacaagacauccuggagaaaacccacaacggcaaacucuguaaccuagacggagucaaaccccucauccucaaagauugcuccgucgccggguggcuccucggcaaccccaugugcgacgaguuccugaacgucuccgaauggagcuacaucgucgaaaaagcauccccagcgaacggacucugcuaccccggugacuucaacgacuacgaagaacuaaaacaccuccuaucacgaaucaaccaccucaagaagaucaaaaucaucccgaaaucguacuggucaaaccacgaagccuccagcggcgucucagccgccugcucauaccucggcgaacccuccuucuuccgcaacgucguauggcucaucaaaaagaacaacaccuacccgcccaucaaagucaacuacacuaacaccaaccaagaagaccuccuaguacucuggggaauacaccaccccaacgacgaaaaggaacaaauccgaaucuaccaaaacccaaacaccucuaucucagucggcacauccacacucaaccaacgccucguaccaaaaauagcuaccagacccaaagucaacggacaaucaggccgcauggaguucuucuggaccauccugaaaccaaacgacucaaucaacuucgacuccaacggcaacuucaucgccccagaauacgccuacaagaucgcaaagaaaggcgacagcguaaucaugaaaucagaacuugaauacggaaacugcaacaccaaaugccaaacccccaugggcgccauaaacagcucgaugcccuuccacaacauccacccacuaaccaucggggaaugcccuaaauacgucaaaucaaaccgguuaguccucgcaacaggacuccgcaacgcgccacagcgcgaaggcggccgccgccgcaaaagaggacucuucggcgccaucgccggcuucauugaaggcggcuggcaaggcauggucgacggcugguacggguaccaccacucgaacgaacaaggcucaggcuacgccgccgacaaagaauccacacaaaaagccaucgacggcaucaccaacaaagucaacuccauaaucgacaaaaugaacacacaauucgaaauagucggcagagaguucaacaaccuggaacgcagaauagaaaaccucaacaagaaaauggaagacggauuccuagacgucuggaccuacaacgccgaacugcucguccuuauggaaaacgaacgcacccucgacuuccacgacucaaacgucaaaaaccucuacgaaaaagucagacuccaacuccgcgacaacgcuaaagaacucggaaacggaugcuucgaguucuaccacaaaugcgacaacgaaugcauggaauccguccggaacgggacauacgacuacccccaguacuccgaagaagcccgccucucccgcgaagaaaucagcggcguuaaaauggaaagcaugguaacuuaccaaauccucucaaucuacucaaccgucgcauccagccuagcacucgcaauaauggucgccggccuaagccuuuggaugugcagcaacggcucccuccaguguagaaucugcauauaa

SEQ ID NO: 215791 - RNA, 1695 nt, Artificial Sequence
  derived and/or modified sequence opt from Influenza A H5N1 hemagglutinin
auggaaaagaucguacuucuucucgccaugauaggacucgucaaauccgaccaaauaugcauaggcuaccacgccaacaacagcaccgaacaagucgacaccaucauggagaaaaacgucacagucacccacgcccaagacauccucgagaaaacccacaacggcaaacuaugcaaccuagacggcguaaaaccccuaauucucaaagacugcuccguggcaggauggcuccugggcaaccccaugugugacgaauuucuaaacgucagcgaauggucauacauagucgaaaaagccucacccgcaaacggccucugcuaccccggcgacuucaacgacuaugaagaacucaaacaccuacucucacgcauaaaccaccugaagaaaauaaaaaucauccccaaauccuacugguccaaccacgaagccucaagcggcgucuccgccgcgugcuccuaccucggagaaccgagcuucuuccgcaacgucguauggcuaauaaagaaaaacaacacauacccacccaucaaaguaaacuacaccaacacaaaccaagaagaccuacucguacucuggggcauacaccacccaaacgacgaaaaagaacagauccgaaucuaccaaaacccaaacacaagcauauccgucggaacaagcacccucaaccagcgccugguccccaaaaucgcaacccgcccaaagguaaacggacaauccggccgcauggaguucuucuggaccauccucaaaccgaacgacuccaucaacuucgacagcaacggcaacuucaucgcaccugaauacgccuacaaaaucgcaaagaaaggagacucaguaaucaugaaaagcgaacucgaauacggcaauugcaacacuaaaugccaaaccccgaugggugccaucaacagcucaaugcccuuccacaacauccacccccuuaccaucggcgaaugccccaaauacgucaaauccaaccgccugguacuagccacaggacuccgcaacgcaccccagacagaaaccagagggcuuuucggcgccauugccggguucauagaaggcgguuggcaaggcauggucgacggcugguacggauaccaccacucaaacgaacaaggaagcggcuacgccgccgacaaagaguccacccagaaagcgaucgacggaauaacaaacaaagucaacagcauaaucgacaaaaugaacacccaguucgagaucguaggccgcgaguucaacaaccuagaacgacgaauagaaaaccucaacaagaaaauggaagacggcuuccucgaugucuggaccuacaaugcagaacuccuaguacucauggagaacgagcgaacacuggacuuccacgacuccaacgucaaaaaccuauaugaaaagguccgccuccaacucagagauaacgccaaggaacuggggaacggcugcuucgaguucuaccacaaaugugacaacgaaugcauggaaagcguccgaaacggcacauacgacuacccccaauacagcgaagaagcacgccucucccgagaggaaaucagcggcgucaaaauggaguccaugguuaccuaccaaauccucuccaucuacuccacuguggcaucaucgcucgcacuagccaucauggucgcggguuuaucccucuggaugugcagcaacggcucccuccaaugccgaauaugcaucuga

SEQ ID NO: 215792 - RNA, 1704 nt, Artificial Sequence
  derived and/or modified sequence opt from Influenza A H5N1 hemagglutinin
auggaaaaaaucguacuccucuucgccgccaucucacucguaaaaagugaucacaucugcauaggcuaccacgcaaacaacucaaccaaacaaguagacaccaucauggaaaaaaacgucacaguaacccacgcccaagacauccuggaaaagacccauaacgguaaacucugugaccucaacggcguaaaaccacuaauccuuaaagacugcucaguagcgggcuggcuccucgggaacccaaugugcgacgaauucauaaacguucccgaaugguccuacauagucgaaaaagccaaccccgcgaacgggcuuugcuaccccggaaacuucaacgacuacgaagaacucaaacaccuccucucaagaaucaaccacuucgaaaaaauccgcaucaucccaaaagacuccugguccgaccacgaagccucccucggcguauccgccgcaugcccauaccaaggcaacuccagcuucuuccgaaacguagucuggcucauaaaaaaagacaacacauaccccaccauaaaaaaauccuacaacaacacaaaccaagaagacuuacucauccucuggggaauacaccaccccaacgacgaagcagaacaaacgagacucuaccaaaacccaacaaccuacauauccaucggcacuagcacgcucaaccaacgacuagugcccaaaaucgccacacgauccaaaaucaacggacaguccggacgaaucgacuucuuuuggaccauacucaagcccaacgacgccauccacuucgaaucaaacggcaacuucaucgccccugaauacgcauacaagauagucaagaaaggcgacagcacaaucaugaaaagcgaagucgaauacggcaacugcaacacacguugucaaaccccaauaggagcaaucaauuccuccaugccauuccacaacauccacccccucacgauaggcgaaugccccaaguacguuaaauccaacaagcuaguacuagccacagggcuacgcaacucgccccaacgagaacgccggcgaaaacgcggacucuucggcgccaucgccggcuuuaucgaaggcggauggcagggcauggucgacggcugguacggauaccaccacagcaacgaacagggcucaggcuacgcagcagacaaagagagcacccaaaaagccauagacggaguaaccaacaaggucaacagcaucaucgacaaaaugaauacccaauucgaagcagucggacgcgaauucaacaaccuagaacgccgaaucgaaaaccucaacaaaaagauggaagacggcuuccuggacgucuggaccuauaacgccgaacuccucguccugauggaaaacgaacgcacccucgacuuccacgacagcaacguacgcaaccuguacgauaaaguccgccuacaacucaaggacaacgccaaagaacugggcaacggcugcuucgaguucuaccacaaaugcaacaacgagugcauggaauccguccgcaacggcaccuacgacuacccccaauacagcgaagaagcgcgccuacggcgcgaagaaaucuccggaguaaaacucgaauccaucggcaucuaccaaauccucuccaucuacuccacagucgccuccucgcugguacucgccauuaugauggccggccuaucccuauggaugugcuccaacggcucccuacaaugccgcaucugcaucuga

SEQ ID NO: 215793 - RNA, 1704 nt, Artificial Sequence
  derived and/or modified sequence opt from Influenza A H5N1 hemagglutinin
auggagaaaaucguccuccugcucgcuauagucagccucgucaaauccgaccaaaucugcaucggauaccacgccaacaacagcacagaacaaguagacaccaucauggaaaagaacgucaccgucacccacgcacaggauauauuagagaaaacacacaacggcaaacuaugcgaccucgacggcgucaaaccccuaauccuccgagacugcuccgucgcaggcuggcuccugggcaaccccaugugcgacgaguucaucaacgucccagaauggucauacauugucgaaaaagcaaaccccgccaacgaccucugcuacccgggaaacuucaacgacuacgaggaacucaaacaccuccucucccgcaucaaucauuucgagaaaauccagaucauccccaaaucaagcuggagcgaccacgaagccucauccggcguuagcagcgccugccccuaucaaggaacacccuccuucuuccgcaacguggucuggcucaucaagaaaaacaacaccuaccccaccaucaaacgauccuacaacaacaccaaccaagaagaccuacuuauccuauggggcauccaccacagcaacgaugccgccgaacaaaccaaacuguaccaaaaccccaccaccuacaucuccgucgguaccuccacacucaaccaaagacugguccccaaaaucgccacccgauccaaagugaacggacaguccgguagaauggacuucuucuggaccauccuaaaaccuaacgacgcaaucaauuucgaauccaacgguaacuucaucgcccccgaauacgccuacaaaaucgucaagaaaggagacagcgccauaauaaaaucagaagucgaauacggaaacugcaacacaaaaugccagacccccaucggagcaaucaacagcuccaugccauuccacaacauacacccccucaccaucggagaaugccccaaauacgucaaaagcaacaaacucguacuagcaacaggccuccgcaacucaccucuccgcgaacgacgccgcaaacgcggacuuuucggagccauagccggcuucaucgaaggaggauggcaaggaaugguagacggcugguauggcuaccaccacagcaacgaacaaggcuccggcuacgccgccgacaaagaaagcacccaaaaagccaucgacggggucacgaacaaaguaaacucuaucaucgacaaaaugaacacacaauucgaagccguaggccgcgaguucaacaaccucgaacgccggauagaaaaccucaauaagaaaauggaagacggcuuccuagacgucuggacuuacaacgcggaacuacugguccucauggaaaaugaaaggacccucgacuuccacgacucaaacgucaaaaaccuauaugacaaaguccgccuccagcuccgcgacaacgccaaagaacucggcaacgguugcuucgaguucuaccacaaaugcgacaacgaaugcauggaauccguacggaacggcaccuacgacuacccccaauacagcgaagaggcccgccuaaaacgagaagaaaucagcggaguaaaacucgaauccaucggcaccuaccaaauacucuccauuuacagcaccgucgccucaucacucgccuuagccauaauggucgccggacuaucguuauggaugugcuccaacggaucccuccaaugccgcauaugcaucuaa

SEQ ID NO: 215794 - RNA, 1695 nt, Artificial Sequence
  derived and/or modified sequence opt from Influenza A H5N1 hemagglutinin
auggaaaagaucguccuccuauucgccaccaucucccucgucaaaucggaccacaucugcauaggcuaccacgcaaacaacuccacagaacaagucgacacaaucauggagaaaaacgucaccguaacccacgcccaagacauccuggaaaagacacacaacgguaaauuaugcgaccuuaacggaguaaagccccucauccuaaaagacugcuccguggcaggauggcuacuuggcaacccacucugcgacgaguucaccaacguccccgaauggagcuacauagucgaaaaagcaaacccagcuaacgaccugugcuacccaggcaacuucaacgacuacgaagaacuaaagcaucuccucagccgcaucaaccacuucgaaaagauccagaucauccccaaagacucgugguccgaccacgaagccucccucggagucagcgcagcaugcuccuaccaaggcaacuccuccuucuuccgaaacguagucuggcucauaaagaaagacaacgccuaccccaccauuaagaaaggcuacaacaacacuaaccgcgaagaccuccucauacucuggggcauccaccacccaaacgacgaagccgaacaaacccgccucuaccaaaaccccacgaccuacauaucaaucgguacaucaacccucaaccaacgccugguccccaaaaucgccacgcgcuccaaaauaaacggacaaucaggccgaauagacuucuucuggaccauacuaaaaccgaacgacgccauacacuucgaauccaacggcaacuucaucgcccccgaauacgccuacaaaaucgucaagaaaggcgacuccacaauaaugaggagcgaagucgaauacggcaacugcaacacucgcugccagacccccaucggggcaaucaacuccuccaugccuuuccacaacauccacccccucacaaucggcgaaugcccuaaauacguaaaaucaaacaaacucguccucgcaaccggccugcggaauagcccccaaagagaaaccagaggacucuucggagccauugcaggauucaucgaagguggcuggcaaggaauggucgacggaugguacggcuaccaccacucaaacgaacaggggagcggguacgcugcagauaaagaauccacccaaaaagcaaucgacggcguaacaaacaaagucaacucaauaaucgacaaaaugaacacacaauucgaagccgucggacgagaguucaacaaccucgaacgccggauagaaaaccucaacaagaaaauggaagacggauuccuagacgucuggaccuacaacgcugaacuacucgugcucauggaaaacgaacgcacgcucgacuuccacgacucaaacgucaaaaaccucuacgacaaaguccgccuacaacucaaagacaacgcuaaagaacucggaaacggcugcuucgaguucuaccauaaauguaacaacgaaugcauggaauccguaagaaacggcaccuacgacuacccccaauacagcgaagaagccagacucaaacgcgaagaaauaagcggagucaaacucgaaagcaucggaaucuaccaaauucucuccaucuacuccaccguggccuccucccuaguccucgcuaucaugauggccggacuuucccucuggaugugcucaaacggcagccugcaaugccgaaucugcaucuag

SEQ ID NO: 215795 - RNA, 1707 nt, Artificial Sequence
  derived and/or modified sequence opt from Influenza A H5N1 hemagglutinin
auggagaaaauaguccuccuccucgccauaguaucccuaguaaaaucagaccagauauguaucggcuaccacgccaacaacagcacagaacaaguagacaccauaauggaaaagaacguaaccgucacccacgcccaagacauccuagagaaaacucacaacggcaaacucugcgaccucgacggcguaaaaccacucauucuccgcgacuguuccguagccggauggcuccuagguaaccccaugugcgacgaauuucucaacguccccgaauggucauacaucguggagaaaaucaaccccgccaacgaccucugcuaccccggagacuucaacgacuacgaagaacuaaaacaccuccucagccgaauaaaucacuucgaaaagauucagaucaucccaaaaagcuccugguccgacuaugaagcguccagcggaguaucaagcgccugccccuaccaaggccgcuccuccuucuuccgaaacgugguguggcugaucaagaaaaacaacgccuacccaacgaucaaaagaucguacaacaacacgaaccaggaagaccuccuaguacuauggggcauacaccaccccaacgacgccgccgaacaaauacgacuauaccaaaacccaaccacauacauauccgucggcaccucaacacucaaccaacgccucguaccaaaaaucgccaccagaucgaaagucaacggccaauccggccgaauggaguucuucuggaccauacucaaaucaaacgacgccauaaacuucgaauccaacggaaacuucauagcccccgaauacgccuacaaaauagucaagaaaggcgacagcacaaucaugaaauccgaacuagaauacggaaauugcaacaccaaaugccaaacccccauaggcgccauaaacuccagcaugcccuuccacaacauccacccacuaaccauaggcgaaugcccaaaauacguaaaaagcaaccgccucguccuagcaacaggccuccgcaacucaccccaaggcgaacgacgccgacgcaaacggggacucuucggcgcaaucgcgggcuucauagaaggcggauggcagggcauggucgacggcugguacggauaccaccacuccaacgaacagggaagcggcuacgcggcagauaaagaaagcacgcaaaaagccaucgacggcgucaccaacaaagucaacagcaucaucaacaaaaugaacacacaauucgaagcugucggcagagaguucaacaaccucgaacgccgcauagaaaaccucaacaagaaaauggaagacggcuuccuggacguauggacauacaacgccgaacuccuaguacucauggaaaacgaacgcacucucgauuuccacgacucaaacgucaaaaaccucuacgacaaaguccgacuacaacuccgcgacaacgccaaggaacucggcaacggcugcuucgaguucuaccaccgaugcgacaacgaaugcauggaaucaguccgaaacggcaccuacgacuacccucaauacagcgaagaagcccgccuaaaaagagaagaaauuucaggcgucaaacucgaaagcaucggaaucuaccagauacucagcaucuacuccaccguagccuccucccuagcccucgccaucaugguagcaggccuauucuuauggaugugcucaaacggaucccuacaaugucggauuugcaucuaa

SEQ ID NO: 215796 - RNA, 1692 nt, Artificial Sequence
  derived and/or modified sequence opt from Influenza A H5N1 hemagglutinin
auggaaaaaaucguccuccuccucgccaucgucagcauaguuaagagcgaccagaucugcauaggauaccacgccaacaacuccacagaacaagucgacacaaucauggaaaaaaacgucacaguaacacacgcccaagacauccuagaaaaaacccacaacggcaaacuaugcaaccucgacggagucaaaccgcucauccuccgcgacugcuccgucgccggcuggcuacucgggaacccaaugugcgacgaauuccucaacguccccgagugguccuacaucguagaaaaaauaaaccccgccaacgaccuaugcuaccccgggaacuucaacgacuacgaggaacuaaaacaccuccucucacgaaucaaccauuucgaaaaaauucaaaucauucccaaagacuccugguccgaccacgaagcguccggcgucucuagcgccugccccuaccaaggccgcuccucauucuucagaaacgucgucuggcucaccaagaaaaaugacgccuaccccacuauaaaaaaauccuauaacaacacaaaccaggaagaccuccucguacuguggggcauccaccaccccaacgacgccgcugaacaaacacgacuauaccagaacccaacaacguacaucucagucggaacaucuacacuaaaccaacgacuuguacccaaaaucgcaacccgaucgaaggucaacggccaaucagggcgcauggaauucuucuggaccauccucaaauccaacgacgcgaucaacuucgagagcaacggcaacuucauagccccagagaacgcauacaaaaucguaaaaaagggcgacuccacaaucaugaaaagcgaacuagaguacuccaacugcaacacgaaaugccaaaccccaaucggcgcaauuaacuccagcaugccauuccacaacauccacccgcucaccaucggagaauguccaaaguacgucaaauccaacagacucguacuagcaaccggacuccgcaacucgccacaacgcgaaacccgaggccuauucggcgcaaucgcuggguucaucgaaggcggcuggcaaggcauggucgacggcugguacggcuaccaccacuccaacgaacaaggcuccggauacgccgccgacaaagaaucgacccagcgcgcaaucgacggaguaacuaacaaagucaacucaaucauagacaaaaugaacacacaguucgaagccgucggccgcgaauucaacaaccucgaacgccgcaucgaaaaccuaaacaagaaaauggaagacggauuccucgacguuuggaccuacaacgcugaacugcucguccucauggaaaacgaacgcacccucgacuuucacgacucaaacguaaaaaaccucuacgacaaaguacgccuccaacuccgcgacaacgcaaaagagcuaggcaacggaugcuucgaauucuaccaucgcugcgacaacgaaugcauggaaucaguacguaacggcaccuacgacuacccgcaauacucagaagaagcacgucucaaaagagaagaaauaagcggcgucaaacuugaaagcaucgggaccuaccaaauccucagcauauacucaacagucgccuccucccuagccuuagccaucaugguagccggucuaucccucuggaugugcuccaacggcucacuccaaugccgcaucugcaucuaa

SEQ ID NO: 215797 - RNA, 1704 nt, Artificial Sequence
  derived and/or modified sequence opt from Influenza A H5N1 hemagglutinin
auggagaaaaucauccuccuacuagccauaaucggccucgucaaauccgaccaaauaugcgucggcuaccacgccaacaacagcacggaacgcgucgacaccaucauggagaaaaacgucacagucacccacgcccaggacauacucgagaaaacccacaacggcaaacucugcaaccucaacggcgucaaaccacuaauacucgaagacuguucggucgcuggauggcuccuuggcaaccccaugugcgacaaauuccucaacguauccgaauggagcuacauagucgaaaaagcaggcccugcaaacggccugugcuacccgggagacuucaaugacuacgaagaacuaaaacaccuccucuccagaauaaaccacuucgaaaagaucgaaaucaucccaaagaaccacugguccaaccacaacacauccggcgucagcuccgcaugcagcuaccuagaaaaccccagcuucuucagaaacguugucuggcuaaccaagaaaaacaauacauaccccacaaucaaaguuaacuacaccaacgcaaaucaaaaagaucuacugguccuauggggcauccaccaccccaacaacgaagcugaacagaaaaugaucuaccaaaacagcaacacauacguauccgugggcaccagcaccuuaaaccaacgacucguccccaaaaucgcaacccgaagcaaagucaacggccaaagcggacgcaucgacuucuucuggacuauccucaaacccaacgacaccaucaacuucgauagcaacggcaacuucaucgcaccaaaguacgccuacaaaauagucaagaaaggagacucggcaauuaugaaauccgaacucaaauaugacaauugcaacaccaaaugccaaacaccaaucggcgccaucaacucauccaugccauuucacaacauccacccacucacuaucggcgaaugcccgaaauacguaaaauccaaccgucuaguacucgccacgggguuacgaaacgccccacaaauagaaggccgacgacgaaaacggggccucuucggcgccaucgccggcuucauagaaggcggcuggcaaggcauggucgacggcugguacggcuaccaccacucaaacgaacaaggcagcggauacgcagcggacaaagaauccacacaaaaagccgucgacggcauaaccaacaaaauaaauucaaucaucgacaagaugaacaaccaauucgaagccguaggccgcgaguucaacaaccucgaacgacgcaucgaaaaccucaacaagaaaauggaagacggcuuccucgacgucuggaccuacaacgccgaacuccuaguacuaauggaaaacgaacgaacccucgauuuccacgacuccaacgucaagaaccuauacgaaaaaguaagacuacaacuccgcgacaaugccaaagaacucggcaacggcugcuucgaguucuaccacaaaugcgacaacgaauguauggaauccgucaaaaacggcaccuacgacuacccccaguacagcgaagaggcccgccucaaccgggaggaaaucucgggcguaaagcucgaaucuacagucaccuaccagauccucuccauauacuccaccguagccucaucacucguacucgcaaucaugguagcagggcucucacuauggaugugcagcaacggaucccugcaaugccgcaucugcaucuaa

SEQ ID NO: 215798 - RNA, 1707 nt, Artificial Sequence
  derived and/or modified sequence opt from Influenza A H5N1 hemagglutinin
auggaacgcaucguacugcuacucgcaauagucucacucgucaaauccgaccaaaucugcauaggcuaccacgccaacaacuccacagaacaggucgacacgauaauggaaaagaacguaacaguaacccacgcacaggacauucucgagaaaacacacaacggaaaacucugcgaccucaacggcgucaaaccccucauccuccgcgacugcuccguggccggauggcuccugggcaacccaaugugcgacgaguucaucaacguccccgaaugguccuacauagucgaaaaagccucccccgcuaacgaccucugcuacccgggggacuucaacgacuacgaagaacucaaacaccuccuaucccgcacgaaccacuucgaaaagauacagaucauaccuccaucaucguggucuaaccacgacgcuucgagcggcgucuccuccgccugccccuaccacggcaggagcucauucuuccggaacguagucuggcucaucaagaaaaacuccgcguacccgaccaucaaaagaagcuacaacaauaccaaccaagaagaccuccuaguacuauggggaauacaccacccaaacgacgcagcagagcagaccaaacucuaccaaaaccccacaaccuacaucucaguaggcaccuccacccuaaaccaaagacucguaccagagaucgccacccgaccaaaagucaacggccaaucaggccgaauggaguucuucuggacaauccucaaaccaaacgacgcuaucaacuucgaaucuaacggcaacuucauagccccagaauacgcguacaaaaucgucaagaaaggagacagcgcaaucaugaaaagcgagcucgaauacgguaacugcaacacaaaaugccaaacucccaugggcgcaauaaacuccagcaugccauuccacaacauacauccgcucacaaucggagaaugccccaaauacgucaaaucaaaccgccuaguccucgccacaggacuacgcaacacaccacaacgagaacgucgacgcaagaaacgaggucucuucggcgccauagccggcuucaucgaaggcggauggcaaggcaugguaaacggcugguacggcuaccaccacuccaacgaacaaggcucaggcuacgccgccgacaaagaguccacccaaaaagccaucgacggcgucaccaacaaagucaauuccaucaucgacaaaaugaacacccaauucgaagcagucggcagagaauuuaacaaccucgaacgucgcauagaaaaccugaacaaacaaauggaagacggcuuccuagacgucuggacauacaacgcagaacuacugguccucauggaaaacgaacgcacacuagacuuccacgacuccaacguaaagcaccucuacgacaaagugcgauuacagcuacgagacaacgcaaaggaacuagguaacgggugcuucgaguucuaccacaaaugcgacaacgaaugcauggaaagcgucaaaaacggcacauacgacuacccacaauacuccgaagaagcucgacucaaccgagaagaaauaagcggcguaaaacucgaauccaugggaaccuaccaaauccucagcauauacagcacagucgcaagcucccuagcccuagccauaaugguugcaggacucagccucuggaugugcuccaacggcucacugcaaugucgcaucugcaucuaa

SEQ ID NO: 215799 - RNA, 1707 nt, Artificial Sequence
  derived and/or modified sequence opt from Influenza A H5N1 hemagglutinin
auggaaaaaaucguucuccugcucgccauaguaucgcuaguaaaaagcgaccaaauaugcaucgguuaccacgcaaacaacucaacagaacaagucgacaccauaauggaaaaaaacgucaccgucacacacgcccaggacauacuagagaaaacccacaacggcaaacucugugaccucaacggcgucaaaccacucauacuccgagacugcagcgucgcuggauggcuccucgggaaccccaugugcgacgaauucaucaacgucccagagugguccuacaucgucgaaaaagccucccccgcaaacgaccucuguuaccccggagacuucaacgacuacgaagaacucaaacaccuccuguccagaaccaaucacuucgaaaagauccaaaucaucccaaaaucaagcuggagcaaccacgacgccucauccggcguaucaucugccugccccuaccacggcagaagcucguucuuccgcaacguagucuggcucaucaaaaaaaacuccgcauaccccaccaucaaacgcucauacaacaacacaaaucaagaagaccuccuaguacucuggggaauccaccacccaaacgacgccgcagaacaaacuaaacuauaccagaacccgacaaccuacaucuccguaggcaccucgacccucaaccaacgccucguaccggaaaucgccacaagacccaaagucaacggacaguccggccgcauggaauuuuucuggacaauccuuaaacccaacgacgccaucaacuucgaauccaacggaaauuucauagcgccagaauacgccuacaaaaucgugaaaaaaggcgacagcgcgaucaugaaaucagaacuggaauacggcaacugcaacacaaaaugccagaccccgaugggcgcuauaaacuccagcaugcccuuccacaacauccacccccucaccaucggcgaaugcccaaaauacguaaagucaaaccggcucguccucgccaccggccucagaaacaccccacaacgcgaacgccgaagaaaaaaacgcgggcuauucggcgcaaucgccggcuucauagaaggcggcuggcaaggcauggucgacggcugguacggcuaccaccacuccaacgagcagggcuccggauacgccgcugacaaagaauccacacaaaaggccaucgacggcguaacuaacaaagucaacuccaucaucgacaaaaugaacacccaguucgaagcagucggacgagaauucaacaaccucgaacgcagaaucgaaaaccucaacaaacaaauggaagacggauuccucgacguauggacguacaacgccgaacuccuaguccucauggaaaacgaacgcacccuagacuuccacgacagcaacgucaaaaaccucuacgacaaaguccgccugcaacuccgagacaacgccaaagaacucggcaacggcugcuucgaguucuaccauaaaugcgauaacgaaugcauggaauccgucaaaaacggaacguacgacuacccacaauacucagaagaggcacgccucaaccgcgaagaaaucagcggagucaaacucgaguccaugggaacauaccagauacucagcaucuacagcaccguugcgucaagccuagcacucgccauaaugguagcaggccuuagccucuggaugugcuccaacggcagccuccaaugccgaaucugcaucuga

SEQ ID NO: 215800 - RNA, 1704 nt, Artificial Sequence
  derived and/or modified sequence opt from Influenza A H5N1 hemagglutinin
auggaaaaaaucguccuacuuuucgccacgaucucccuagucaaauccgaccacaucugcaucggauaccacgcgaacaacagcacagagcaagucgacaccaucauggaaaaaaacguaaccguaacccacgcccaagacauccuagaaaaaacucacaauggcaagcucugcgaccucaacggcgucaaaccccucauccugaaagacugcuccguugccggcuggcuucuaggaaaccccaugugcgacgaauucauuaacguccccgaauggagcuauaucgucgagaaagccaaccccgcuaacgaccucugcuaccccggcaacuucaacgacuacgaagaacucaaacaucuccucucccgcauaaaccacuucgaaaaaauacaaaucauacccaaaaacucuuggucagaccacgaagcaucacuaggagucuccgcagcauguccauaccaaggcaaaucauccuucuuccgaaacgucguauggcugaucaaaaaagacaacgccuaccccaccauaaaaaaaggcuacaacaacacgaaucaagaagaccuacucguccucuggggcauccaccacccuaacgacgaagcagaacagacccgccucuaccagaaccccacuaccuacaucagcaucggcacuagcacccucaaccaacgccucguacccaaaaucgcuacccgcuccaaaaucaacggccaguccggccgcaucgacuucuucuggaccauccuaaaacccaacgacgcaauccacuucgaauccaauggcaacuuuaucgcccccgaauacgccuacaaaaucgucaaaaaaggggacuccaccauaaugaaaagcgaagucgaguacggcaacugcaacacucgcugccaaacacccaucggcgcaaucaacucaucaaugcccuuccacaacauccacccccucaccaucggcgaaugcccaaaauacgucaaaagcaacaagcuugucuuagccaccggccuccgcaacuccccacaacgagagcgccgacgcaaacgaggccuauucggagccauagccggcuucaucgaaggcggguggcaaggaauggucgacggcugguacggauaccaccacuccaacgaacaaggcagcggcuacgccgcagacaaagagucgacacaaaaagccauagacggcgucaccaacaaagucaauucaauaaucgacaaaaugaacacccaauucgaagccgucggccgagaauucaacaaccuggaacggcgcauagaaaaucuaaacaaaaagauggaagacggcuuccucgacgucuggaccuacaacgccgaacuccuaguacucauggaaaacgaacgcacacucgacuuccacgacuccaacguacgcaaccuguacgacaaaguccggcuccaacucaaagacaaugccaaagaacuaggcaacggaugcuucgaguucuaccacaaaugcgacaacgaaugcauggaaucaguucgaaauggcacguacgacuauccccaauacuccgaagaagcccgacucaaacgugaagaaaucuccggcgucaaacucgaguccaucgguaucuaucaaauccucagcauauacuccaccgucgccucgagccucguccucgccauaaugauggccggacuaucacucuggaugugcagcaauggaucccuccaaugcagaauaugcaucuaa

SEQ ID NO: 215801 - RNA, 1707 nt, Artificial Sequence
  derived and/or modified sequence opt from Influenza A H5N1 hemagglutinin
auggaaaagaucguccuccuccucgcaaucguaagccucgucaaaagcgaccaaaucugcaucggcuaccaugcaaacaacagcaccgaacaagucgacacaauaauggagaaaaacguaacggucacccacgcucaagacauucuagagaaaacacacaauggcaaacuaugcgaccuagacggcguaaaaccgcucauccuccgcgacugcuccguagcaggguggcuccuaggaaaccccaugugcgacgaauuuaucaacguccccgaauggucuuacaucguagaaaaagccaaucccaccaacgaccucugcuacccaggguccuucaacgacuacgaagaacucaaacaccuccugucccgaauuaaccacuucgagaaaauccagaucauaccaaaaagcaguugguccgaccacgaagccuccuccggcgucagcucagcaugcccauacuuaggguccccgagcuucuuccgcaacguagucuggcucauaaagaaaaacagcacguaccccaccaucaagaaaagcuacaacaacaccaaccaagaagaccuucuagucuuauggggcauacaccaccccaacgacgccgccgaacaaacccgccucuaucagaaccccaccaccuacaucuccaucggcaccucaacccuaaaccaaagacucgucccaaaaauagcuacaagauccaaagucaacggccaauccggccgaauggaauuuuucuggaccauacucaaacccaacgacgcaauaaacuucgaauccaacggcaacuucaucgcccccgaauacgcauacaaaaucgucaagaaaggcgacagcgcgaucaugaaauccgaacuggaauacggcaacugcaacacaaaaugccaaacccccaugggcgccaucaacagcagcaugcccuuccacaacauccacccacucaccauaggcgaaugcccaaaauacgugaaaaguaaccgccuaguccuagcaacgggccucagaaacucaccccaacgcgaaucacgcagaaagaaacgcgggcuguucggcgccauagccggcuucaucgaaggcggauggcaaggcaugguagacggcugguacggauaccaccacagcaacgaacaaggcuccggauacgccgccgacaaagaaucgacccaaaaagccaucgacggaguuaccaacaaaguuaacuccaucaucgacaaaaugaacacccaauucgaagcagucggcagagaguucaauaaccucgaacgccgcauagaaaaccucaacaagaaaauggaagacggguuccuagacguguggacauacaacgccgaacuacucguccugauggaaaacgaacgaacccuggacuuccacgacuccaacgucaaaaaccuauacgacaaaguaagacuccaacuacgcgauaacgcuaaagaacuaggcaauggaugcuucgaguucuaccacaaaugcgacaaugaaugcauggaauccauccggaauggcaccuauaacuacccccaauacucagaagaagcccgccucaaacgcgaagaaaucagcggagucaaacuggaaucgaucggcaccuaccagauacuaagcaucuacucaaccguagccucuucgcucgcccuagcuauaaugauggccggccucucacucuggaugugcagcaauggcagucuacaaugccgaaucugcaucuaa

SEQ ID NO: 215802 - RNA, 1707 nt, Artificial Sequence
  derived and/or modified sequence opt from Influenza A H5N1 hemagglutinin
auggaaaagaucguacuacuccucgccaucgucucacucgucaaauccgaccaaaucugcauuggauaccacgcaaacaacuccaccgaacagguagacaccauuauggaaaagaacguaacugucacucacgcccaagacauccucgaaaagacccacaacggcaaacucugcgaccucgacggcguaaaaccacucauccuaagagacugcuccguagccgguuggcuccucggcaaccccaugugcgacgaguucauuaacgugcccgaaugguccuacauagucgaaaaagccaaccccacaaacgaccuaugcuaccccggcucauucaacgacuacgaagaacuuaagcaccuacucucacgaaucaaccacuucgagaaaauccaaauaauccccaaaagcucaugguccgaccacgaagcaucaaguggcguguccagcgccugcccauaccucggcagccccagcuucuuccgcaacguagucuggcucauaaagaaaaacucaaccuaccccacaaucaagaaaagcuacaacaacaccaaccaagaagaccuccucguacuauggggcauccaccacccaaacgacgcagccgaacaaacuaugcucuaccaaaacccaacgaccuacauaagcaucggcacaagcacgcucaaccaacgccucguaccuaaaaucgccacccgauccaaagucaacggccagucagggcguauggaguucuucuggaccauacugaaaccaaacgacgcaaucaacuucgaauccaacggcaacuucaucgccccagaauacgccuacaaaauuguaaagaaaggggacucagccauaaugaaaucugaacuagaauacggcaacugcaacacaaaaugccaaacccccaugggcgccaucaacucaagcaugcccuuccacaacauacauccacucacaaucggcgaaugcccaaaauacgucaaaagcaacagacucguccucgccaccggccuccgaaacuccccacaacgagaaagccgccggaagaaacgcggccuauucggcgccauagccggguucaucgaaggcggguggcagggcaugguagacggcugguacggcuaccaccacagcaacgagcaaggcagcggcuacgcagcagauaaagaaucgacacaaaaagcaauagacggagucacaaacaaagucaacuccaucaucgacaaaaugaacacccaauucgaagccguaggccgagaguucaacaaccucgaacgccgcauagaaaaccuaaacaagaaaauggaagaugguuuccuagacguauggacauacaacgcagaacuccuaguacucauggaaaacgaacgcacccuagacuuucacgacagcaacgucaaaaaccuuuacgacaaaguaagacuccaacuacgcgacaacgccaaagaacuaggaaacggauguuucgaauuuuaccacaaaugcgacaacgaaugcauggaaucaauccguaacggaacauacaacuacccacaauacagcgaagaagcccgucucaaacgggaagaaauauccggagucaaacuggaauccaucggaacguaccaaauccuaucaauauacucaaccgucgccagcagccucgcgcucgccauaaugauggcaggacuaucccucuggaugugcucaaacggaagccugcaaugccgaauaugcaucuaa

SEQ ID NO: 215803 - RNA, 1707 nt, Artificial Sequence
  derived and/or modified sequence opt from Influenza A H5N1 hemagglutinin
auggaaaaaaucguucuccuucuugccaucguaucacuaguuaaaucagaccaaaucugcaucggcuaccacgcuaacaacucaaccgaacaagucgacacaauaauggaaaaaaacguaacuguaacccacgcccaagacauccuagaaaagacccacaacggcaaacucugcgaccucgacggugucaaaccccuuauccuaagagacugcagcgucgcaggcuggcugcucgggaacccaaugugcgacgaauucaucaacgucccagaauggucauacauaguagaaaaagccaaccccaccaacgaccucuguuaccccggaucauucaacgacuacgaagaacucaaacaccuccucucucgaauaaaccacuucgagaaaauccaaaucauccccaaaucuucuuggucagaccacgaagccucuagcggcgucuccagcgcaugccccuaccucggaucccccuccuucuuccgcaacgucgucuggcucaucaaaaaaaacucgaccuaccccaccaucaaaaaaucauacaacaacaccaaccaagaagaccuacuaguacucuggggcauccaccaccccaacgaugcagcugaacaaacccgucucuaccaaaaccccacaaccuacaucucuaucggaacgagcacccucaaccaacgccuaguccccaaaauugccacaagaucaaaaguaaacggccaaucgggccgaauggaauucuucuggaccauccuuaaaccaaaugaugccaucaacuucgagucaaacggcaacuucauugcaccagaauacgccuacaaaaucguaaagaagggcgacucagccaucaugaaaucggaacucgaauacggcaacugcaacaccaaaugccaaacaccaaugggcgcaaucaacagcuccaugccauuccacaacauccacccucucaccauaggagaaugccccaaguacgucaaaagcaaccgucuuguacucgcaaccggacuccgaaacagcccacagcgagaaagccgccgcaagaaacguggccucuuuggagcaauagcaggcuucaucgagggcggcuggcaaggcauggucgacggcugguacggauaccaccacucuaacgaacaaggauccggcuacgcagccgacaaagaauccacccaaaaggccaucgauggaguaaccaacaaagucaacuccaucauagauaaaaugaacacacaauucgaggcaguuggccgcgaauucaacaaccuggaacggcgcaucgaaaaccucaacaagaagauggaagacggcuuccuugacgucuggacauauaacgccgaacuccucguccucauggaaaacgaacgcacccucgacuuccacgacucaaacgucaaaaaucucuacgacaaaguccgacuccaacuccgcgacaacgcuaaagaacucggcaacggcugcuucgaauucuaccacaaaugcgacaacgaaugcauggaauccauacgcaacggcaccuacaacuauccacaguacucagaagaagcccgccucaaacgcgaagaaauaucuggcgucaaacucgagagcaucggcacauaccagauucucucaaucuacuccacagucgcaagcucacuagcccuagccauaaugauggccggccucucgcuauggaugugcuccaaugguucccuacaaugccgcaucugcaucuaa

SEQ ID NO: 215804 - RNA, 1707 nt, Artificial Sequence
  derived and/or modified sequence opt from Influenza A H5N1 hemagglutinin
auggaaaaaaucacccuacuccuaucaauagucucgcucguaaaauccgaccaaaucuguaucggcuaccacgcaaacaacucaaccgaacaagucgacaccaucauggagaaaaacguaaccguaacccacgcccaagacauccucgaaaaaacgcacaacggcaagcucugcgaccuugacggcgucaagccacucauccuaaaggacugcuccgucgcuggcuggcuccuagguaaccccaugugcgaugaauucaucaacguccccgaaugguccuacaucgucgaaaaagccaaccccaccaacgaccucugcuaccccggaagcuucaacgacuacgaagaacuaaaacaccuccuuucccgcaucaaccacuucgaaaaaauacaaaucauacccaaaagcagcuggucagaccacgaagcuucauccggcguauccucagcaugccccuacuuaggcuccccgucauucuuccgaaacgucguauggcucauaaaaaaaaacagcaccuaccccacaauaaaaaaaaccuacaacaacaccaaccaagaagaccugcucauccucuggggcauccaccacccaaacaacggcgccgagcaaaccaugcucuaccagaaccccacaaccuacauaagcauaggcaccuccacacucaaccaacgccucguccccaagaucgccacaagaagcaaagucaauggccagagcggacgcauggaauucuucuggacaauccucaaacccaacgacgccaucaacuucgaaagcaacggcaacuucaucgcccccgaauacgcauacaaaaucgucaaaaaaggcgauucagccaucaugaaaucagaacucgaauauggcaacugcaacacaaaaugccagaccccaaugggcgcaaucaacucgucaaugcccuuccacaacauccacccaaucaccaucggcgaaugccccaaauacgucaaauccaaccgccuaguacucgccaccggucuacggaacuccccacaacgagaaucccgacgcaaaaaacgcggccuguucggugccauagccggcuucauagagggaggcuggcaaggaaugguagacggcugguacggcuaccaccacagcaacgaacagggcagcggcuacgcagccgacaaagagucaacacaaaaagcaaucgacggagugaccaacaaaguaaacagcaucaucgacaaaaugaacacccaauucgaagccgucggccgugaauucucaaaccucgaacgcagaaucgaaaaccucaauaaaaaaauggaagacggcuuccucgacgucuggaccuacaacgcggagcuucuaguccuaauggaaaacgaacgcacccuggacuuccacgacuccaacgucaagaaccucuaugacaaaguccgccuccaacugcgcgacaacgcgaaagaacuuggcaacggcugcuucgaguucuaucauaaaugcgacaacgaaugcauggaauccauacgcaauggaaccuauaacuacccccaguacagcgaagaggcucgacucaaacgcgaagaaaucagcggcgucaaacuagaauccaucggcaccuaccaaauccucagcaucuacucaaccguagcauccucacucgcucucgccaucaugaucgccggccucagccucuggaugugcagcaacgguucccuccaaugccgcauaugcaucuaa

SEQ ID NO: 215805 - RNA, 1707 nt, Artificial Sequence
  derived and/or modified sequence opt from Influenza A H5N1 hemagglutinin
auggaaaaaauaaugcuccuacuagccaucgucucgcucgucaaauccgaccaaaucugcaucggcuaccacgccaacaacagcacagaacaagucgacaccauaauggaaaagaacguaaccguaacccacgcccaagacauauuagaaaaaacccacaauggcaaacucugcgaccucgacggagucaaaccucucauccuaagagacugcuccgucgccggauggcuacucggcaaccccaugugcgaugaguuccucaacguaccagaauggagcuacauagucgaaaaaaucaaccccgccaacgaccucugcuacccaggaaacuucaacgacuacgaggaacuuaaacaccuauuaucgagaaucaaccauuucgagaagauccaaauaauccccaaauccucguggucugaccacgaagccuccagcggugucuccagcgccugcccauaccagggccgaucauccuucuuccgaaacgucgucuggcucaucaaaaaagacaacgcauacccuaccauaaaacgcucguacaacaacacaaaucaagaagaccuccuaguacuauggggcauccaccacccaaacgacgccgcagagcaaacaaggcucuaucagaaccccaccacauacaucucaguaggcaccagcacccucaaccaaagacucguccccaaaaucgccacccgguccaaagugaacggacaaucaggccgcauggaauucuucuggacaauacuaaaaccaaacgacgccaucaacuucgaaucaaauggcaacuucaucgcccccgaaaacgcauacaaaauagucaagaaaggggacucaaccaucaugaaauccgaacucgaauacggcaacugcaacaccaaaugccaaaccccgauaggagcaaucaacucaagcaugcccuuccacaacauacacccccucaccauaggagaaugcccaaaauacgucaaaagcaaccgacucguccuagccaccggacuaagaaacucaccccaaggcgaacgccgacgcaaaaagcgaggccucuucggagccaucgccgguuucaucgaaggcggcuggcaaggcaugguagacggcugguacggcuaccaccacuccaacgaacaaggcuccggcuacgcagcagacaaagaaagcacccaaaaagccaucgacggcgucaccaacaaaguaaacuccauuauagacaaaaugaacacacaauucgaggccguaggacgagaauucaacaaccucgaacggcgcaucgaaaaucuaaacaaaaaaauggaagacggcuuccucgacgucuggaccuacaaugccgagcuccucguacuuauggaaaacgaacggacccuugacuuccacgacuccaacgucaaaaaccuguacgacaaaguccgccuacagcuacgugacaacgccaaagaacucggcaacggguguuucgaauucuaccaccgaugugacaacgaaugcauggaguccguacgcaacgggaccuaugacuacccacaauacuccgaagaagcccgacucaaacgagaagaaaucuccgggguaaaauuagaaagcauaggcaccuaccagauacucagcauauacagcaccgucgccuccagccucgcccuagcaaucaugguugccggccucucccuauggaugugcuccaacggcagccugcagugccgcauaugcaucuaa

SEQ ID NO: 215806 - RNA, 1707 nt, Artificial Sequence
  derived and/or modified sequence opt from Influenza A H5N1 hemagglutinin
auggaaaagauaguccucuuacuugccaucguaucacucguaaaaucagaccaaaucugcaucggcuaucacgccaacaacuccaccgaacaagucgacacaaucauggagaaaaacguaacgguuacacacgcccaagacauccuagagaaaacacacaacggcaaacucugcgaccucgacggcgucaaaccccuaauccuacgcgacugcagcgucgcaggcuggcuccucggcaaccccaugugcgacgaguuccuaaacguucccgaauggucguacaucguagagaaaaucaaccccgccaacgaccuaugcuaccccggcaacuucaacgacuacgaagaacuaaaacaccuacucucacgaaucaaccacuucgagaaaauccaaaucauacccaaaagcucauggagcgaccacgaagccuccgcaggcgucucuuccgccugcccguaucaaggcaugagcucguucuuccgcaacgucgucuggcucaucaaaaaggacaacgccuaccccacaauaaaacgauccuacaacaacaccaaccaagaagaucuccuagucuuauggggcauccaccacccaaacgacgccgccgaacaaaccaagcucuaucagaacagcacuaccuacaucagcgucggaaccagcacacuuaaccagcgccuaguccccaaaaucgcaacccgauccaaagucaacggccaaucaggccgaaucgaauuuuucuggacuauccuaaagcccaacgacaccauaaacuucgaaagcaacggcaacuucaucgccccagaaaacgccuacaagauagucaagaaaggagacuccaccaucaugaaguccgaacucgaauacggaaacugcaacaccaaaugucaaaccccaaucggcgcaaucaacucuagcaugcccuuccacaacauccacccccuuaccaucggagaauguccaaaauacgucaaaucaagccgacucgugcucgccaccgggcuccgcaacagcccccagggcgaacgacgccgaaagaaacgcggccucuucggcgcaaucgccggcuucauagaaggcggauggcaaggcauggucgacggaugguacggauaucaccacuccaacgaacaaggcuccggcuacgccgcagacaaagaauccacacaaaaagccaucgacggcgucacaaacaaaguaaacuccaucaucgacaaaaugaauacccaauucgaagccgucggacgagaguucaacaaccucgaacgacgcaucgaaaaccuaaacaagaaaauggaagacggauuccucgaugucuggaccuacaacgccgaacuccucguccuaauggaaaacgaacgcacacucgacuuccacgacagcaacgucaaaaaucucuacgacaaaguccgacuccaacuccgagacaacgcaaaagaacucggcaacgggugcuucgaguucuaccaccgcugugacaacgaauguauggaaucaguaagaaacggcacguacgacuacccccaauacagcgaagaggcccgccuaaaaagagaagaaaucuccggcgucaaacuugaaagcauaggcaccuaccaaauacucucaaucuacucaacagucgccagcagccucgcacucgccaucaugguagccggccucucccucuggaugugcagcaacggaagccugcaaugccggaucugcauauga

SEQ ID NO: 215807 - RNA, 1707 nt, Artificial Sequence
  derived and/or modified sequence opt from Influenza A H5N1 hemagglutinin
auggaaaaaauaguccuacuccucgccaucgucucccuagucaaaucggaccaaaucugcaucggauaccacgccaacaacagcacagaacaagucgacaccaucauggaaaaaaacgugaccguaacccacgcacaagacauccuagagaaaacccacaacggaaaacucugcgaucuggacggcguuaaaccacuaauacuccgagacugcucagucgccggcuggcuccuaggcaaccccaugugcgacgaauuccucaacgucccggaaugguccuacauaguagaaaaaauaaaucccgccaacgaccuuugcuacccgggcaacuucaacgacuaugaagaacuuaaacacuuacucagcaggauaaaccacuucgaaaaaauccaaauaauacccaagucaucauggucagaccacgaggccuccgccggcguaucaucagcgugccccuaccaaggccgcagcuccuucuuucgcaacgucgucuggcucauuaaaaaagacaaugcauacccaaccauaaaacgauccuauaacaacaccaaccaagaagaccuacucguucucuggggaauacaccaccccaacgacgccgccgaacaaacccgccuauaccaaaacuccacaaccuacauaucagucggcaccucaacccucaaucaacgccucguccccaaaauagccaccagaucaaaagucaacggccaaagcggacgcaucgaauucuucuggaccauccucaagcccaacgacaccaucaacuucgaauccaacggaaacuucauagcacccgaaaacgccuacaaaauagucaaaaaaggcgacucaacgauaaugaaauccgaacucgaauacggaaacugcaacaccaaaugccaaacccccaucggcgccaucaacuccuccaugccauuccacaacauacacccacuaaccaucggagaaugccccaaauacgucaaguccucaaggcucguacuagcaaccggacuccgcaacuccccacaaggggaacgccgccgcaaaaaacgcggccuauucggcgccauagcaggcuucaucgaaggcggcuggcaagguaugguagacggcugguacggauaucaccacagcaacgaacaaggcuccggcuacgccgccgacaaagaaucaacacaaaaagccaucgacggcguuacaaacaaaguaaacuccauuauagacaaaaugaacacgcaauuugaagcgguuggccgggaauucaauaaccucgagagacgcaucgaaaaccuaaacaaaaaaauggaagacggauuccucgacgucuggaccuacaacgcggaauuacucguccucauggaaaacgaaagaacacucgacuuccacgacucaaacgucaaaaaccucuacgacaaaguccgcuugcaacucagggacaacgccaaggaacugggcaacggcugcuucgaauucuaccaccgcugcgacaacgaaugcauggaauccgugcgcaacggaacauacgacuacccucaguacuccgaagaggcccgacuaaaacgcgaagaaaucagcggcgucaaacuagaauccauaggcaccuaccaaauacuguccauauacaguaccgucgcgucuucacuugcccucgcuaucauggucgcaggccucuccuuauggaugugcuccaacgggucccuccaaugccggaucugcauuuaa

SEQ ID NO: 215808 - RNA, 1707 nt, Artificial Sequence
  derived and/or modified sequence opt from Influenza A H5N1 hemagglutinin
auggaaaagaucguacuccuccuagcaauuguaucacucgugaaauccgaccaaauuugcaucggcuaccacgccaauaacuccacagaacaagucgacaccaucauggagaaaaacgucaccgugacccacgcccaagacauccucgagaaaacccacaacggcaaacuaugcgaccuagacggugucaaaccccuaauccuuagagacugcuccgucgcgggauggcuccuaggcaaccccaugugcgacgaguuccucaacgucccagaauggagcuauaucguggaaaagauaaaccccgcaaaugaccucugcuaccccggaaacuucaacgauuacgaagaacucaaacaccuccucuccaggaucaaucacuucgagaaaauacaaaucauccccaaauccuccuggucagaccacgaagccuccgcuggcgucucgagcgcaugcccguaccagggacgcagcucauucuuccgcaaugucguauggcugaucaagaaagacaacgcguacccaacaaucaaacgcuccuacaacaacacaaaccaagaagaccuccucguacucuggggaauacaccaccccaacgacgccgccgaacaaacacgccucuaccaaaacccgaccacauacaucucaguaggaaccucaacccuuaaccaacgccuagucccaaaaaucgccacccgaucaaaaguaaacggacagagcggacgaauggaguucuucuggacaauacugaaaccuaacgacgccauuaacuucgaauccaacggcaacuucauagcaccagaaaacgcauacaaaauaguaaagaaaggagacuccaccauaaugaaaucagaacucgaauacggcaacugcaacaccaaaugccagacgcccaucggcgcaaucaacuccuccaugccguuccacaacauacacccacucaccaucggcgaaugccccaaauacgucaaauccucccgccucguacuagccaccggacuccggaacagcccgcaaggcgaacgacgacgcaaaaagcgaggccucuucggggccaucgccggcuucauagaaggcggcuggcagggaauggucgacggcugguacggguaccaccacuccaacgaacaaggcucaggcuacgcugccgacaaagaauccacccaaaaagcaaucgacggcgucacuaacaaaguaaacuccauaaucgacaaaaugaacacccaauucgaagcaguaggacgggaguucaacaaccucgaacgccgcauagaaaaccucaacaagaaaauggaagacggcuuccuagacgucuggaccuacaacgcagaacuccucguacuaauggaaaaugaacgaacccucgacuuccacgacuccaacgucaaaaaccucuacgacaaaguccgacuacaacuaagagacaacgccaaagaacuaggcaacggaugcuucgaauuuuaccaccggugcgacaacgaaugcauggaaagcguccgcaacggaaccuacgacuacccacaauacuccgaagaagcccgccuuaaaagagaagaaaucucaggcgucaaauuggaauccaucgggacuuaccaaauacuguccauauacuccaccgucgccuccagccuagcccuggcaaucauggucgcaggccucucccucuggaugugcuccaacggcagccuacaaugccgcauaugcaucuga

SEQ ID NO: 215809 - RNA, 1695 nt, Artificial Sequence
  derived and/or modified sequence opt from Influenza A H5N1 hemagglutinin
auggaaaagauaguccuccugcuugccaucgucucgcucgucaaauccgaccaaauaugcaucggcuaccacgccaauaacucaaccgaacaagucgacaccaucauggagaaaaacgugaccgucacccacgcucaagacauccucgagaaaacacacaacggcaaacucugcgaccuagacggcguaaaaccacugauccuaagagacugcuccguugccggcuggcuccuuggaaaccccaugugugacgaauuucucaacguuccagaauggagcuacaucgucgagaaaaucaaccccgcgaacgaccucugcuacccaggaaacuucaacgacuacgaagaacucaagcaccuccucucccgcaucaaccacuucgagaaaauccaaaucauccccaaaucaucgugguccgaccacgaagcauccuccggagucucaucagcgugcccauaccaaggccgcagcucauucuuccgcaacguggucuggcucauaaagaaagacaacgcauaccccaccaucaaacguuccuacaacaacaccaaccaagaagaccuccuaguccucuggggcauucaccaccccaacgacgcagcagaacaaacccgccucuaccaaaacccaacaaccuacauauccgucggaaccuccacccuuaaccaacgccucguacccaaaauugcuacacgaagcaaagucaacggccagagcgggcgcauggaauuuuucuggaccauccucaaaccaaacgacgcaauaaacuucgaaagcaacggcaacuucaucgcacccgaaaacgccuacaaaaucgugaagaaaggugacucaaccauaaugaaauccgaacucgaauacggaaacugcaacacgaaaugccaaacccccaucggcgcgaucaacagcucaaugccauuccacaacauccacccgcucaccauaggcgaaugcccuaaauacguaaaauccaaccgucucguccuugccacuggccuucggaacagcccccagaucgaaacccgcggacuuuucggugccauagccggcuucaucgaaggcgguuggcaaggaaugguggacggcugguacggcuaccaccacuccaacgaacaaggaucaggauaugccgccgacaaagaauccacccagaaagccauagacggcgucaccaacaaagucaacucuaucaucgacaagaugaacacucaauucgaagccguaggccgggaguucaacaaccuggaacgacgcaucgaaaaccuaaacaagaaaauggaagacggcuuccuagacguauggaccuacaacgcagaacuucuaguccucauggaaaacgaacgcacccucgauuuccacgacuccaacgucaaaaaccuuuacgacaaaguacgcuuacaacuaagagacaacgccaaagaacucggaaacggcugcuucgaguucuaccaccgcugcgacaaugaauguauggaaucaguccgaaacgggaccuacgacuacccccaauacuccgaagaagcgcgacuaaaaagagaagaaauaucgggagucaaauuggaaucaaucggcacauaccaaauccucucgaucuacuccaccgucgccagcucacuagcccucgccauaaugguagccggucucucccuguggaugugcuccaacggcucgcuccaaugucgcauauguaucuaa

SEQ ID NO: 215810 - RNA, 1701 nt, Artificial Sequence
  derived and/or modified sequence opt from Influenza A H5N6 hemagglutinin
auggaaaagaucguccuacuacucgcggucgucucccucguaaaaagcgaccaaauaugcaucggauaccacgcaaacaacuccaccgagcaagucgacaccauuauggaaaagaacguaaccguaacacacgcccaagacauccucgaaaagacccacaacggacgucuaugcgaccucaacggaguaaaaccccucauccuaaaagacugcucaguagccggauggcuccugggcaaccccaugugcgacgaguucauccgcguaccagaauggucauacaucgucgagcgcgccaaccccgccaacgaccucugcuacccaggaaaccucaacgacuacgaggaacuaaaacaccuacuaucacguaucaaccacuucgagaaaacacuaauaaucccaaaguccucauggccaaaccacaccagcagcggggucuccgccgcaugccccuaccaaggcacacccuccuucuuccgcaacgucguguggcucaccaagaaaaacgacgcauaucccaccaucaaaaugagcuacaacaacacaaaccgcgaagaccuccucauccucuggggcauccaccacucaaacaacgcagcugaacaaaccaaccucuacaaaaaccccaccacauacguauccgucggaaccucaacacucaaccaacgccucguacccaaaaucgccacccgcucacaagucaacggccaacgaggccguauggacuucuucuggaccauacuaaaaccaaacgacgccauccacuucgaauccaacggaaacuucaucgcucccgaauacgccuacaaaaucguaaagaaaggcgacuccaccauaaugaaauccgaaauggaauacggucacugcaauacaaaaugccaaacucccauaggcgccauaaacucuucaaugcccuuccacaacauccauccccucaccauaggagaaugccccaaauacguaaaaaguaacaaacucguucuagcaaccggacuucgaaacucaccccuccgcgaacgccgccgaaaacggggacucuucggagcaauagcaggcuucaucgaaggcggcuggcaaggcauggucgacggaugguacggcuaccaccacuccaacgagcagggcucuggcuacgccgccgaucgagagagcacacagaaggcaaucgacggggucacaaacaaaguaaacucaaucauagacaaaaugaauacccaauucgaagcgguaggccgcgaguucaacaaccuagaaaggcgaaucgaaaaccucaacaagaaaauggaagauggcuuccucgacgucuggaccuacaacgccgaacuauuaguacuaauggaaaacgaacgaacccuagauuuccacgauaguaacgucaaaaaccuauacgacaaaguacgccuacaacuccgagacaacgccaaagaacuaggcaacggcugcuucgaguucuaccacaaaugcgacaacgaaugcauggaaucaguccggaacggaaccuacgacuacccccaauacuccgaagaagcuagacugaaacgagaagaaauauccggagucaaacucgaaucaauaggcacauaccagauccucuccaucuacucaacaguagcuuccagccucgcccucgcaauaauagucgcuggccucagccucuggaugugcagcaacggcucucuacaaugcagaauaugcauauag

SEQ ID NO: 215811 - RNA, 1704 nt, Artificial Sequence
  derived and/or modified sequence opt from Influenza A H5N6 hemagglutinin
auggagaaaaucguccuacuacucgccgucguaucccucgucaaauccgaccaaaucugcauuggcuaccacgcaaacaacucaaccgaacaaguugacaccaucauggaaaagaacgucaccgugacccacgcccaagacauccucgaaaaaacccacaacgggcgcuuaugcgaccucaacggcguaaaaccccuaauccucaaagacugcuccguagccggcuggcuccucggcaaccccaugugcgacgaauucauacgaguaccagaaugguccuacauagucgaacgcgccaaccccgcaaacgaccucugcuaccccggcaaucuaaacgacuaugaggaacucaaacaccuacucucacgcauaaaccacuucgaaaaaaccuuaaucauacccaaaucgucauggcccaaccacgagacaucccuuggcgucucagccgcaugccccuaccagggaaugcccagcuucuuucgcaacguaguauggcucaccaaaaaaaacgacaccuaccccacaaucaaaauguccuacaacaacaccaaccgcgaagaccuacuaauccugugggguauacaccacucaaacaacgccgcagaacaaacaaaccucuacaaaaaccccacgaccuacguuagcgucggaaccgccacucucaaccagcgccucguacccaaaauagccaccagaagccaagucaacggccaacgcggcagaauggacuucuucuggacaauccugaaaccaaacgacgccauacacuucgaaucaaacggcaacuucaucgcccccgaauacgcuuacaagaucguuaaaaaaggcgacuccacuaucaugaaauccgaaauggaauauggccacugcaacaccaaaugccaaacccccaucggcgcgauaaacucauccaugccauuccacaacauccacccccucaccaucggagagugccccaaauacguaaaauccaacaaacucguccuagcuaccggacuccgcaacucaccccuacgugaacgacgacgaaaacggggccucuucggcgccaucgcuggcuucaucgaaggcggauggcaaggaauggucgacggcugguacggcuaccaccacuccaacgaacagggcucgggcuacgcugccgaccgcgagagcacacaaaaagcuaucgacggagucaccaacaaagucaacuccaucauagacaaaaugaacacccaguucgaagccgucggccgcgaauucaauaaccuagaacgucguauagaaaaccugaacaaaaaaauggaagacggcuuccucgacgucuggaccuacaacgccgaacuccuuguccucauggaaaacgaacgcacucuagacuuccaugacuccaacgucaaaaaucucuacgacaaaguccgccuacaacuacgcgacaacgcgaaagaacucgguaauggaugcuucgaauucuaccacaaaugcgacaacgaaugcauggaauccguucgcaacggaacauacgacuacccccaauacucagaagaagcccgccucaaacgagaggaaaucucaggaguaaaacucgaaagcaucggaaccuaccagauacucucaaucuacucaaccgucgccuccucccuggcccucgccauaaucgucgccgggcucagccucuggaugugcuccaacggaucccuccaaugccgcauaugcaucuaa

SEQ ID NO: 215812 - RNA, 1704 nt, Artificial Sequence
  derived and/or modified sequence opt from Influenza A H5N6 hemagglutinin
auggagaaaaucguacuacuacucgccgucgucucccuagucaaaucagaccagauaugcaucggauaccacgccaacaacucaaccgaacaagucgacacgaucauggagaaaaacgucacggucacucacgcucaggauauccucgagaaaacccacaacgggcgccuaugcgaccuaaacggagucaaaccacucauccucaaagauugcuccguagccggcuggcuacuuggcaaccccaugugcgacgaguucauacggguaccagaauggagcuacaucguggaacgagccaacccagcaaaugaccucuguuaccccggcaacuuaaacgacuacgaagaacucaaacaccuacucucccgaaucaaccacuucgaaaagacacucaucauaccuaaaucaagcuggccgaaccacgagaccucgcugggcguauccgccgccugccccuaccaaggcgucccuucuuucuuccgcaacguugucuggcuaaccaagaaaaacgacgccuacccaaccaucaaaauguccuauaacaacaccaaccgagaagaccugcuuauccucuggggcauccaucacagcaacaacgccgccgaacaaacaaaccucuacaaaaaccccaccacauacgucucggucgggacaagcacccucaaccagcgacucguaccgaaaaucgccacacggucacaggucaacggccaacgaggcagaauggacuucuucuggaccauacucaaacccaacgacgccauccacuucgaauccaacggaaacuucaucgcccccgaauacgccuacaaaaucgucaagaaaggagacuccaccaucaugaaauccgaaauggaauacggccacuguaacacgaaaugccaaacacccaucggcgccaucaacucaucaaugcccuuccacaacauccacccccuuaccaucggcgaaugccccaaauacgucaaaucaaacaaacucguccuagccacaggacucaggaacucaccccugcgcgagcgaagacgaaaacgaggccucuucggagccaucgccggcuucauagaaggcggauggcaaggcaugguagacggaugguacggauaccaccauuccaacgaacaaggguccggauacgccgcagaccgagaaucgacccaaaaggccaucgauggcgugaccaacaaaguaaacuccaucaucgacaagaugaacacacaauucgaagccgucggaagagaguucaacaaccuagaacgccggaucgaaaaccucaacaagaaaauggaagacggguuccucgacgucuggaccuacaacgccgaacuccuuguccuaauggagaacgaacgaacccuagacuuccaugacagcaacgucaaaaacuuauacgacaaaguacgccuccaacuccgagauaacgccaaagaacuaggcaauggcugcuucgaguucuaccacaaaugcgacaacgaaugcauggaaagcguacgcaacggcaccuacgacuacccucaauacuccgaagaagcccgacucaaacgcgaagagaucuccggagucaaacucgaauccauagggacauaccaaauauuauccaucuacuccacagucgccuccucacucgcccuagccaucaucguagccggccucucacucuggaugugcuccaacggcagccuccaaugccgaaucugcauuuaa

SEQ ID NO: 215813 - RNA, 1704 nt, Artificial Sequence
  derived and/or modified sequence opt from Influenza A H5N6 hemagglutinin
auggagaaaauagugcuacuacuagcaaucgucucacucgucaaaggagaucaaaucugcaucggcuaccacgccaacaacagcaccgaacaaguggacaccauaauggagaaaaacgucaccgucacucacgcacaagacauccuagagaaaacacacaacgggaaacucugcgaucucaacggcgucaaaccacucauccuaaaagacugcuccguggcaggauggcuccuaggcaaccccaugugcgacgaauuuauccggguaccagaaugguccuacaucgucgaacgcgcaaaccccgcaaacgaccuaugcuacccaggaaaccucaacgacuacgaagaacucaaacaccuacucaguagaaucaaccacuucgaaaagauccugauaaucccgaaaucguccuggaccaaccacgaaacaucccucggcgucucagcugcaugcccauaccagggcaccccguccuucuucagaaacgugguuuggcuaaucaagaaaaacgacgcauacccaacaaucaaaaucucauacaacaacaccaaccaagaagaccuccucauacucuggggcguacaccacagcaacaacgccgcagaacaaaccaaccucuacaaaaaccccaccaccuacaucagcgucggaacuuccacauuaaaccaacgccucguccccaaaauagccacccgcucccaagucaacggacagcgcggccguauggacuucuucuggacaauccuaaaaccaaacgacgccauccacuucgaaagcaacggcaacuucaucgccccggaauacgccuacaaaaucgugaagaaaggagacuccaccaucaugaaaagugaaauggaauacggccacugcaacacaaaaugccaaacccccauaggagcaaucaacucaucuaugcccuuccacaacauacauccacucaccaucggcgaaugcccgaaauacgucaaauccaauaaacucguccucgccaccggucuacgcaacucuccccuccgcgaaaaacgccggaaacgaggccucuucggcgccaucgcaggcuucaucgaaggcggguggcagggcaugguagacggaugguacggguaccaccacuccaacgaacaaggcagcggcuacgcugccgacaaagaaagcacccagaaagccaucgacggcguaaccaacaaagucaauagcaucauagacaaaaugaacacccaauucgaagcaguaggccgugaauuuaacaaccuagaacgccgaaucgaaaaccucaacaagaaaauggaagacggcuuccuggacgucuggacauacaacgccgaacuacucguccuaauggaaaacgaacgcacacucgacuuccacgacuccaaugucaaaaaccucuacgacaaagugcgacuacagcuccgcgacaacgcaaaagaacucgguaacggaugcuucgaauuuuaccacaaaugcgacaacaaauguauggaaucaguccgaaacggcaccuacgacuacccccaauacuccgaagaagcacgacuaaaaagagaagaaaucuccggcgucaaacucgaauccauagguaccuaccaaauccuauccaucuacagcaccguagcauccucucuagcccucgcaauaaucgucgcuggccucucccucuggauguguucaaacgguucacuccaaugccguaucugcaucuaa

SEQ ID NO: 215814 - RNA, 1701 nt, Artificial Sequence
  derived and/or modified sequence opt from Influenza A H5N6 hemagglutinin
auggagaaaaugguacuccugcucgcagucgucagccucgucaaaagcgaccaaaucugcauaggcuaccacgcgaacaacagcacagaacaagucgacaccauaauggaaaagaacguaacaguaacacacgcacaagacaucuuagagaaaacgcacaacggacgacucugcgaccucaacggcgucaaaccacucauacuaaaagacugcagcgucgcaggcuggcuccuaggaaauccaaugugugacgaguucauccgugucccagaaugguccuacaucgucgaacgcgccaaccccgccaacgaccugugcuauccaggaaaccuaaacgacuacgaagaacucaaacaucuacucucccggaucaaucacuucgaaaagacccugaucauaccaaaaagcagcuggccaaaccacacauccuccggcgucuccgcagccugccccuaccaaggaaugcccuccuucuuccguaacgucgucuggcucaccaagaaaaacgacgcguacccgaccaucaagauguccuacaacaacaccuaccgcgaagaccuucucauccucuggggcauccaccacagcaacaacgcagcagaacaaacaaacuuauacaaaaacccaaccacguacguaagcgucggcacauccacccuaaaccaaagacuagaacccaaaauagccacccgcagccaaguaaacggccagcgcggucgcauggacuucuucuggacaauccucaagcccaacgacgcaauacacuuugaauccaacggcaacuucauagccccagaauaugccuacaaaauagucaagaaaggcgauucaaccauaaugaaaagcgaaauggaauacggacacugcaacaccaaaugucaaacgcccaucggcgcaauaaacuccuccaugccauuccacaacauacacccgcucaccaucggagaaugcccaaaauacgugaaguccaacaaacucguacuagcaacaggacuacgcaacuccccacuacgcgagcgccgccgcaaacgcggacuauucggugcgaucgccggcuuuaucgaaggcggauggcaaggaauggucgacggcugguacggguaccaccacuccaacgagcaaggaucaggcuaugccgccgaccgagaaagcacgcaaaaagccaucgauggcgucaccaacaaagucaacuccaucaucgacaaaaugaacacgcaauucgaggcgguaggccgcgaguucaacaaccuggaacgacgcauagaaaaccucaacaagaaaauggaagacggguuucuagacguguggaccuacaacgccgaacuacugguacucauggaaaacgaacgcacacucgauuuccacgacagcaacgugaagaaccucuacgacaaaguccgccuccagcuccgagacaacgccaaagaacucggcaacggaugcuucgaguucuaccauaaaugcgacaacgaaugcauggaaucaguacggaacggaaccuacgacuacccccaauacuccgaagaagcacgacucaaacgagaagaaauauccggagucaaacuugaaaguaucggcaccuaccagauccuaagcaucuacuccaccgucgcauccucacuggcccucgcaauaaucguagccggccucucacucuggaugugcagcaacggcucacuccaaugccgaaucugcaucuaa

SEQ ID NO: 215815 - RNA, 1701 nt, Artificial Sequence
  derived and/or modified sequence opt from Influenza A H5N6 hemagglutinin
auggaaaagaugguacuacuucucgcugccguuucccuggucaaauccgaccaaaucugcauaggcuaccacgcaaacaacucaacagaacagguagauaccauaauggagaaaaaugucaccgucacgcacgcacaagacauccucgagaaaacccacaacgggcgccucugcgaccuaaacggcguaaaaccacuaauccuuaaagacugcuccgucgccggauggcuccucggcaacccgaugugcgaugaauuuauccguguaccagaaugguccuacauagucgaacgcgccaacccugcaaacgaccucugcuaccccggcaaccucaacgacuacgaagaacugaaacaccucuuaagcagaaucaaccacuucgagaaaacacucauaauacccaaauccucuuggcccaaccacaccuccagcggggucuccgccgcgugccccuaccagggcaugcccucuuucuuccgcaacgucguauggcuaaccaagaaaaacgacgcauaccccaccauaaaaauguccuacaacaacaccuaccgcgaagaccuccucauccuauggggaauccaccacagcaacaacgcagcagaacaaacaaaccucuacaaaaacccaaccaccuauguguccgucggcaccucaacacucaaccagcgacucgaaccaaaaauagcgacacgcucccaagucaauggccagcgcggccgcauggacuucuucuggacaauccucaaacccaacgacgccauccacuucgaaagcaacggcaacuucaucgcucccgaauacgccuacaaaaucgucaagaaaggagacucuaccaucaugaaaagcgaaauggaauacggacacugcaacacaaaaugccaaacgcccaucggcgcaaucaacagcagcaugcccuuccacaacauccacccacucaccaucggcgaaugccccaaauacgucaaaucuaauaagcuaguccucgcaaccggccucaggaacagcccccuccgagaacgucgccgcaaacgcgggcuauucggcgcaaucgcggguuucaucgaaggcggauggcaaggcauggucgacggcugguacggauaccaccacuccaacgaacaaggcuccggauacgccgccgaccgagaaagcacacaaaaggccaucgacggcgucaccaacaaagucaacagcaucaucgacaaaaugaacacccaguuugaagccguuggccgagaguucaacaaccuugaacgccgcaucgaaaaccucaacaagaaaauggaagacggauuccuagacguguggacauacaacgccgaacuucucguccucauggaaaacgaaagaacacuagacuuccacgacucaaacgucaaaaaccucuacgacaaaguacggcuccaacuccgagacaacgcaaaagaacuaggcaacggaugcuucgaguucuaccacaaaugcgacaacgaaugcauggaaucgguacgcaacgggaccuacgacuauccccaauacucggaagaagcacgacucaaacgcgaagaaauauccggcgucaaacucgaauccauuggcaccuaccaaauccucuccauauacucaaccgucgccucgucccucgcgcucgccauaauaguagccgguuuaucacucuggaugugcagcaacggcucccuccagugucgaauauguaucuaa

SEQ ID NO: 215816 - RNA, 1704 nt, Artificial Sequence
  derived and/or modified sequence opt from Influenza A H5N8 hemagglutinin
auggaaaaaaucguccuacuccuagcagucaucucccucgucaaaucagaccaaaucuguauaggauaccacgccaacaacucaacaaaacaagucgacacgaucauggagaaaaacgucaccguaacacaugcucaagacauccucgaaaagacccacaacggcaaacucugcgaccucaacggcgucaaaccccuaauccucaaagacugcuccgucgcuggcuggcuacucggaaaccccaugugcgacgaauucauccgcguuccagaauggucauacaucguagaacgagcaaaccccgcaaacgaccuaugcuaccccggaacccucaacgacuacgaagaacuaaaacaccucuuaucccgaauaaaccacuucgaaaaaacgcugaucaucccccgcagcuccuggcccaaccaugaaaccucccugggcgucucagccgccugccccuaucaaggcgccucauccuucuuucguaacguuguauggcugaucaaaaaaaacgacgcauaccccaccaucaaaaucucuuacaacaacaccaaccgagaagaccuacucauacuauggggaauccaccacuccaacaacgcagccgaacagacaaaccucuacaaaaaccccgacaccuacgucuccgucggcaccuccacccuaaaucagcgccuagucccaaaaaucgccacccgaucccaagucaacggacaguccggccgaauggacuucuucuggaccauccuuaaaccaaacgacgccauacacuucgaaucaaacggcaacuucaucgccccagaauacgccuacaaaaucgucaaaaaaggagacagcaccauaaugaaauccgagauggaauacggucacugcaauaccaaaugccagacccccauaggagccaucaacagcuccaugccauuccacaacauccacccuuuaaccaucggcgaaugccccaaauacguaaaauccaauaaacucguccucgcaaccggccuacguaacagcccccuccgcgaacgccgacgcaaacgcgggcuuuucggcgcaauagcaggcuucauagaaggaggcuggcagggcauggucgauggcugguacggauaccaccacuccaacgagcaaggaucaggauacgcagccgacaaagaaucaacccagaaagcaaucgacggcgucaccaacaaaguaaacucaauuaucgacaaaaugaacacccaauucgaagcagucggccgugaauucaacaaucucgaacgacgcaucgaaaaccugaacaaaaaaauggaagacggcuuccuagacguauggaccuacaacgcagaacuccucguccucauggaaaacgagcgcacguuagacuuccaugacucuaacgucaaaaaccuauacgacaaaguaagacuccaacuucgagacaacgccaaagaacugggcaacgggugcuucgaauucuaccacaaaugcgacaacgaaugcauggaaagcguccgcaacggcaccuacgacuacccaaaauacucagaagaagccauccucaaacgcgaagaaaucagcggcguaaaacuugaauccaucggcacauaccaaauccucuccauuuacuccacaguggccucaucccuggcccuggcaauaauagucgccggacucagccuauggaugugcagcaacggaucccuucaaugucgcaucugcauuuaa

SEQ ID NO: 215817 - RNA, 1704 nt, Artificial Sequence
  derived and/or modified sequence opt from Influenza A H6N1 hemagglutinin
augaucgcaauaguagucaucgccauacuugccagcgccggaaaaucagacaaaauaugcaucggcuaccacgccaacaacucaaccacccaagucgacacccuccuagaaaagaacgucacagucacccacagcgucgaacuccuagaaaaccagaaagagaaaagguucugcaagauaaugaacaaggcgccccuugaccucaaagacugcacaaucgaaggauggauccucgggaacccaaaaugugaucuccuacuaggcgaccagagcuggaguuacaucguagaacgaccaaacgcccagaacggcaucugcuaucccggcgucuuaaacgaacucgaagaacucaaagccuucauaggcagcggagaaagagucgaacgauucgaaauguucccaaaaagcaccugggccggcgucgacaccucccgcggcgucacaaacgccugcccauccuacaccauagacucauccuucuaccgaaaccucguauggaucguaaaaaccgacucggccaccuaccccguaaucaagggcacauacaacaacacaggcacacaacccauacuguacuucuggggaguacaccacccacuagacacaaccgugcaagacaaccucuacggcucgggagacaaguacguccgaaugggaaccgaguccaugaacuucgccaaauccccagaaauagccgcgcgccccgccgucaacggccaacgauccagaauagacuacuacuggagcguccuccgccccggagagacacuaaacguagagucaaacggaaaucucauagcccccugguacgcauacaaauucguguccacgaacaagaaaggcgcagucuucaaauccgaccuaccaaucgaaaauugcgacgcaaccugccagacaaucaccggcguacuccgcaccaacaaaaccuuccaaaacgucuccccacuauggaucggagaaugucccaaauacgucaaaagcgaaucacucagacucgccaccggacuccgcaacgucccccaaaucgccacccgaggaauauucggagccaucgccggcuucaucgaaggcggauggaccggaaugauagauggaugguacggcuaccaccaugaaaacucccagggauccggcuacgccgccgacagagaauccacccaaaaagcaauugacggcauaaccaacaaagucaacuccaucaucaauaaaaugaacacccaauucgaagcagucgaccacgaguucagcaaccucgaacgccgaauaggcaaccucaacaaacgcauggaagacggcuuccucgaugucuggacauacaaugccgaacuccucguucuccuagaaaacgaacgcacccuagaccuccacgacgccaacguaaagaaccucuacgaaaaaguaaaaucacaacuccgcgacaacgcaaacgaccuagggaacggcugcuucgaguucuggcacaaaugcgacaacgaaugcauggaaucagucaaaaacggcaccuacgacuaccccaaauaccaaaaagaaucaaaacuaaaccgccaagggaucgaaucaguaaaacucgaaaaccuaggcgucuaucaaauccucgcaauauauagcacaguaucaucaucgcucgucuuaguaggccucaucauggccaucggccuauggaugugcagcaacggcucaaugcaaugcagaaucugcaucuaa

SEQ ID NO: 215818 - RNA, 1704 nt, Artificial Sequence
  derived and/or modified sequence opt from Influenza A H6N1 hemagglutinin
augauagcaaucgucgugaucgcgauacuagccucugccggcaaaagcgacaagaucugcauaggauaccacgccaacaacuccacaacucaggucgacacccuacucgagaaaaacgucaccgucacccacagugucgaacuccuugaaaaucagaaagaaaagcgauucuguaaaaucaugaacaaagcaccccuagaccucaaagacugcaccaucgaaggguggauccuaggaaaccccaaaugcgaccuacuacugggugaccaaucauggucauacauuguagaacgaccgaacgcacaaaacggaaucugcuaccccggcguccuaaacgagcucgaagaacucaaagccuucaucggcucgggcgaacgcgucgaacgcuucgaaauguuccccaaguccaccugggccggcguugacaccagcagaggcgucacaaacgccugcccaagcuacaccauugacagcagcuucuaucgcaaccuagucuggaucgucaaaaccgacucugcaaccuacccagucaucaaaggcacauacaacaacaccggcacacaacccauacucuacuucuggggcguccaccacccacucgacacaacaguccaggacaaccuguacggcucaggggacaaauacgugcgaaugggcaccgaauccaugaacuucgccaagagccccgaaaucgccgccaggcccgcagugaacggccagcgcagcagaauagacuacuacugguccguacuacgacccggcgagacccugaacguagaaagcaacggcaaccuaaucgcaccaugguacgccuacaaauucguaucaacaaacaagaaaggcgccgucuucaaaagcgaccucccaaucgaaaauugcgacgccacgugccagaccauaacaggaguccuccgcaccaacaagacauuccaaaacguaucgccgcuauggauaggcgaaugccccaaauacguuaaaucagaaucccuccgccuagccaccggccugcguaacguaccacaaaucgcaacccgagggaucuucggagccauagcaggauuuaucgaaggcggauggacaggaaugaucgacggcugguacggcuaucaccacgaaaacagccaaggcuccggcuacgccgccgaccgcgaaucaacacaaaaggcgauugacggaauaacaaacaaagucaacagcauaauaaacaaaaugaacacccaguuugaggccguagaccacgaguucucaaaccuagaacgccgcaucggcaaccuaaacaaacgcauggaagacggcuuccuagacgucuggaccuacaacgcagaacuccucguccuccuagaaaacgagcgaacccucgaccuccaugacgccaacgucaaaaacuuauacgaaaaaguaaaaucgcaacucagagacaacgccaacgaucucggcaacggcugcuucgaguucuggcacaaaugugauaacgaaugcauggaaucagucaaaaacggcacauacgacuacccaaaauaccaaaaagaaucaaaacucaaccgacaaggcauagaaucaguaaaacucgaaaaccucggcgucuaccaaauccuagccauauacagcacagucuccuccagccucguccucguaggccucaucauggccauuggccucuggaugugcagcaacggcucaaugcaaugccgaauaugcaucuag

SEQ ID NO: 215819 - RNA, 1692 nt, Artificial Sequence
  derived and/or modified sequence opt from Influenza A H7N7 hemagglutinin
augaacacccaaauucuuguauucgcccuuguagcaguaauccacaccaacgcagacaaaaucugccucgggcaccacgcagucucuaacggcaccaaagucaacacgcucaccgaacgcggaguagaagucguuaacgccaccgaaacaguagagcgaacaaacaucccaaaaauaugcuccaaaggcaagagaacaguagaccucggccagugcggccuucucggcaccauaaccggcccaccccaaugcgaccaauuccucgaguucagcgccgaccucaucauagaacgccgcgacggcaacgacgucugcuaccccggaaaauucgucaacggagaggcgcugcgccaaauccuacgaaagucaggcggaauaaacaaagagaccaugggcuucaccuauuccggcauccgaaccaacggcacgaccucagcaugcagacgcuccggcuccucguucuacgccgaaaugaaauggcuccucagcgacaccgacaacgcagccuucccucaaaugaccaaaucauacaaaaacacccgacgagaacccgcccuaaucguauggggaauccaucacagcgggagcaccaccgaacaaaccaagcucuacggcuccggcaacaagcuagugacgguaggguccucaaaauaccaacaauccuucguccccagcccagguacaagaccccagguaaacggccaguccggaagaauagauuuccacuggcucauacucgacagcaacgacaccguuacauucuccuucaacggagccuucauagcccccgaccgagcaucauuccucaaaggaaaaucaaugggcauccaaagcgacguccaagucgacgccaacugcgaaggcgaaugcuaccacuccggcggcacaauaacaagcucccuccccuuccaaaauaucaacagccgggccguaggcaaaugcccccgcuacgucaaacaagaaucucuccuccuagcaacaggcaugaaaaacguaccagaacucccaaagaaaagacgaaaacgaggacucuucggcgccaucgccggcuuuauugaaaacgggugggagggccucgucgacggaugguacggcuuccgccaccaaaacgcacaaggagagggaacagcagcagacuacaaaucaacccaaagcgcaauagaccaaaucaccggcaaacucaaccgccuaaucgagaaaaccaaccaacaauucgagcuaaucgacaaugaguucaccgaaguagaaaagcaaaucggcaacgucaucaacuggacccgcgacaguauaacagaagucuggagcuacaacgccgaacuacucgucgcaauggaaaaccagcacaccaucgaccucgcagacagcgaaaugaacaaacucuacgaaagaguccgaaagcaacuccgagaaaacgccgaagaagacggcaccggaugcuucgaaauauuccacaaaugcgacgaugacugcauggcauccauacgcaacaacaccuacgaccacagcaaauaccgcgaagaagcaaugcagaaccgcauccaaauugacccaguaaaacucuccggcggcuacaaagacgucauccugugguucuccuucggagccuccugcuuccuacuccuagccaucgcaaugggccucgucuucauaugcgucaaaaacggcaacaugcgaugcacaauaugcaucuaa

SEQ ID NO: 215820 - RNA, 1692 nt, Artificial Sequence
  derived and/or modified sequence opt from Influenza A H7N7 hemagglutinin
augaacacgcaaauucucguauucgcccuaguagccgucauccacacaaacgcugacaaaauaugccuaggacaccacgcaguuagcaacggaaccaaagucaacacccugaccgagcgcggcguagaagucgucaacgcaacggaaaccguggaacgcaccaacauacccaaaauaugcuccaaggggaaacgaaccguagaccucggacaaugcggccuacucgggaccaucacaggacccccacaaugcgaccaguuccucgaguucagugccgaccucaucauagaacgccgcgacggcaacgacgucugcuaccccggcaaauucguaaacggagaagcgcugcgccaaauccuccgcaagagcggaggcaucaacaaagaaaccaugggcuucaccuacucgggcaucagaaccaacggcacgacaucagcaugccgccgcagcggcucgagcuucuacgcggaaaugaaauggcuacucuccgacacagauaacgcagccuucccacaaaugaccaaguccuacaagaacacacgucgcgaacccgcacucaucguauggggcauacaccacuccggaagcaccacagaacaaaccaaacuauacggcagcgguaacaaacucgucaccgucggcucaucaaaguaccaacagagcuucgucccuaacccagaaacacgcccccaaguaaacggacaaagcggacgaauagacuuccacuggcucauccucgacuccaacgacaccguaaccuucucauucaacggcgccuucaucgcgccggacagagcaucauuccuaaagggaaaauccaugggaauacaauccgacguccaagucgacgccaacugcgaaggcgaaugcuaccacagcggaggcaccaucaccucaagccucccauuccaaaauaucaacucacgcgccgucggaaaaugcccgagauacgucaaacaagaaagccuacuacuggcaacgggaaugaaaaacguucccgaacuacccaagaaacgaagaaaacggggacuauucggcgccauagccggcuuuauugaaaacggaugggaaggacucgucgacggaugguacggcuuccggcaccaaaacgcacaaggcgaagguacugccgccgacuacaaauccacccaaagcgccauagaccaaauaaccggaaaacugaaccgacucauagaaaagacgaaccaacaauucgaacugaucgacaacgaguucaccgaagucgaaaaacaaaccggaaacgucaucaacuggacacgggacagcaucaccgaagucuggagcuacaacgccgaacuacuuguagccauggaaaaccaacacacaaucgaccucgccgacagcgaaaugaacaaacucuacgaacgcguacgcaaacaacucagagaaaacgccgaggaagacgggaccggaugcuucgagaucuuccacaaaugcgacgacgacugcauggccuccauccgcaacaacacauacgaccacagcaaauaccgagaagaagccaugcaaaaccgcauacaaaucgaccccgucaaacuuuccggaggcuacaaggacgucauacuaugguuuagcuucggagcgucaugcuuccuacuccuggccaucgcaaugggauuggucuucaucugugucaaaaacggaaacaugcguugcaccaucugcaucuaa

SEQ ID NO: 215821 - RNA, 1683 nt, Artificial Sequence
  derived and/or modified sequence opt from Influenza A H7N9 hemagglutinin
augaacacccagauccucguauucgcccucauagcaaucauccccaccaacgccgacaaaaucugccuaggccaccacgccgucucaaacggcaccaaaguaaacacacucaccgagcgaggcguagaagucguuaacgcaaccgaaacaguugagaggacaaauauaccccgcaucugcucaaaaggcaaacgcaccguagaccucggucagugcggacuacuaggcacaauaacagggccaccacagugcgaccaguuccuggaauuuuccgccgaccuaaucaucgaaagacgcgaaggaucggacgucuguuaccccggaaaauuugucaacgaagaggcccuacgccaaauccuccgggaauccggaggaaucgacaaggaggccaugggcuuuaccuacucaggaauaaggaccaacggagcaacaagcgccugcagacgcucaggcucaucauucuacgcggaaaugaaauggcuacugucaaacacagacaacgccgccuucccccagaugaccaaaucauauaaaaacacaagaaaguccccagcccucauaguauggggcauacaccacagcgucuccaccgcugaacaaacaaaacuauacggcuccggaaacaagcuagucacagucggcagcucaaacuaccaacaaucuuucguccccagccccggcgcccgaccacaagucaacggccuaagcggccgaaucgacuuccacuggcuaaugcugaaccccaacgacaccguaaccuucagcuucaacggagccuucauagcccccgaccgggccuccuuccuaagagggaaaagcaugggcauccaaucaggcguacaaguagacgcaaacugcgaaggagacugcuaccacuccggaggcaccauaauuuccaaucuacccuuccaaaacaucgauucacgagccguaggaaaaugcccccgguacgucaaacagcgcucacuccuacuugccaccggcaugaaaaacguacccgaaauacccaaaggccgcggacucuucggagccaucgcgggcuucaucgaaaacggcugggaaggccuaaucgacggcugguacggcuuccgccaccaaaacgcgcaaggcgaaggcacagcagcagauuacaaauccacccaaucugcaauagaccaaauaacaggaaaacucaaccgccuaauagagaaaaccaaccaacaauucgaacucauagacaacgaguucaacgaagucgaaaaacagauaggaaacgucaucaacuggaccagagacuccaucacagaaguguggucauacaacgccgaacuacugguagccauggaaaaccagcacacgauagaccucgcagacagcgagauggacaaacucuacgaacgaguaaaacgacaacuacgagaaaacgccgaggaagacggaaccgggugcuuugaaaucuuccacaaaugcgacgacgacugcauggccagcauccgcaacaacacauacgaccacuccaaauaccgcgaagaagcaaugcaaaaccgaauacaaaucgacccgguaaaacuaagcuccggcuacaaagacgucauccucugguucucauucggcgcauccugcuucauccuccuggccaucgucaugggccuagucuucaucugcgucaaaaacggcaacaugcgcugcacaaucugcaucuaa

SEQ ID NO: 215822 - RNA, 1704 nt, Artificial Sequence
  derived and/or modified sequence opt from Influenza A H7N9 hemagglutinin
auggaaaagaucguccuccugcucgccaucgucagccuagucaaaucggaccaaaucugcaucggauaccacgcaaacaacagcaccgaacaaguggacaccaucauggagaaaaacgucacaguaacccacgcacaagacauacuugagaaaacccacaacggcaaacucugcgaccuagacgggguaaaaccucuaauccucagagacugcuccgucgccggauggcuccuaggaaaccccaugugcgacgaguucauaaacguacccgaguggagcuacaucgucgaaaaagccaacccagcaaacgaccugugcuaccccggcaacuucaacgacuacgaagaacugaaacaccuacucucacgcaucaaccacuucgagaaaauacaaauaauaccaaaaagcucguggucagaccaugaagcaucaagcggggucagcagcgccugccccuaccaaggcacccccuccuucuuccgcaacgucguguggcucauaaagaagaacaacaccuacccaacaauaaaaagaucauacaacaacacuaaccaggaagaccuccuaauccuguggggaauccaccacucaaacgacgcagccgaacaaaccaaacuauaccagaaccccaccacauacauuagugucgguaccuccacacuaaaccaacgacucguccccaaaauugccaccagauccaaagucaacggacaauccgguagaauggacuucuucuggaccauacuaaaacccaacgacgcaaucaacuucgaaucaaacgggaacuucaucgcaccagaauacgccuacaaaaucgugaagaaaggcgacucagcaaucguuaaaagcgaggucgaauacggcaacugcaacaccaaaugccaaacccccaucggcgccaucaacuccuccaugcccuuccacaacauccacccgcuaaccaucggagaaugccccaaauacgucaaauccaacaaauuaguacuagcaaccggucuccgcaacucaccccuccgcgagcgcagacgaaaacggggccucuuuggcgccauagccggcuucaucgaaggcggcuggcaaggcaugguagacggcugguaugguuaccaccacuccaacgaacaagggucaggauacgccgccgacaaagaauccacccaaaaagccauagacggcguaacaaacaaagucaacucaaucauagacaaaaugaacacccaguucgaagccguagggagagaguucaacaaccucgaacgccgaaucgaaaaccuaaacaagaaaauggaagacggcuuccuagacguguggacguacaacgcugaacuccuaguacuaauggaaaacgaacggacccuagacuuccacgacagcaacgucaaaaaccuauacgacaaaguccgacuccaacuccgcgacaacgcaaaagaacucggcaacggaugcuucgaguucuaccauaaaugcgauaacgaaugcauggaaagcgucaggaacggcaccuacgacuacccgcaauacucagaagaagcucgccucaaacgagaagaaauaucaggagucaaacuagaaucaauaggcacauaccaaauacuauccauauacuccacaguagcauccucccucgcgcucgcgauaaugguagcaggccuaagccucuggaugugcucaaacggaucccuucaaugccgcauuugcaucuaa

SEQ ID NO: 215823 - RNA, 1683 nt, Artificial Sequence
  derived and/or modified sequence opt from Influenza A H7N9 hemagglutinin
augaauacccaaauccucguauucgcacucaucgcaauaauccccacaaacgccgacaaaaucugccucggccaccacgccgucucaaacggcaccaaagugaacacacucacagagagaggcgucgaaguagucaacgcaaccgaaaccguagaacggaccaacauacccagaaucugcagcaaaggcaaacgcaccgucgaccucggccaaugcggccugcucggaacaaucacaggacccccucaaugcgaccaauuccuagaguucuccgcagaccugauaauugaacggcgagaaggcagcgacgucugcuaccccggcaaguucgucaacgaagaagcucuccgccaaauacuacgcgaaagcggcggcauagacaaagaagcgaugggcuucaccuacucaggcauacgcaccaacggcaccaccucagccugccgacgaaguggcuccagcuucuacgccgaaaugaaguggcuacuaagcaacaccgacaacgcagccuucccccaaaugacgaaaucauacaaaaacaccagaaaaagccccgcacucauuguauggggaauacaccacuccguaucaaccgcggaacaaacaaaacucuacggauccggcaacaagcuagucacagucggauccucaaacuaccagcagagcuucguacccagccccggcgcucgcccccaagucaauggacuauccggucgcaucgacuuccacuggcuuaugcucaacccaaacgacaccguaacauucucuuucaacggagcguucauagccccagaucgugccaguuuccuacgcggaaaauccaugggcauacaauccggcguccaaguagacgccaacugcgaaggagacugcuaccacagcgggggcacaauuaucucaaaccuacccuuccaaaacaucgacucacgagcagucggcaaaugccccagauacgucaaacaacgaucacuccuacuagcaacaggcaugaaaaacgucccagaaauaccaaaagggcgaggacucuuuggcgccauagccggcuucaucgagaacggaugggaaggacuaauagacggcugguacggcuuccgacaccaaaacgcccaaggagaaggaaccgcggcggacuacaaauccacccaaucggcaaucgaccaaauaacaggcaaacucaaccgacucauagagaaaaccaaccaacaauucgaacugaucgacaacgaguucaacgaaguagaaaaacaaauuggcaacgucaucaacuggaccagagauucaaucacagaaguaugguccuacaacgccgaacuccuagucgcaauggaaaaccaacacacaaucgaccuagcagacucggaaauggacaagcuauacgaaagaguaaaacgccaacuccgcgaaaaugccgaagaagacggcacaggcugcuucgaaaucuuucacaaaugcgacgacgacugcauggccucgaucagaaacaacaccuaugaucacuccaaguaccgcgaagaggcaaugcaaaaccgaauccaaaucgaccccgucaaacucuccagcggcuacaaagacgucauacugugguucuccuucggagcaagcugcuucauccuccucgccauaguaaugggccucgucuucauaugcgucaaaaacggcaacaugagaugcaccaucugcauauaa

SEQ ID NO: 215824 - RNA, 1683 nt, Artificial Sequence
  derived and/or modified sequence opt from Influenza A H7N9 hemagglutinin
augaacacccaaauccuaguauucgcacucaucgcaaucaucccaaccaacgccgacaaaaucugccucggucaccacgcagucagcaacgguaccaaagucaacacgcuaaccgaacgcggagucgaaguagucaacgccacagaaacagucgaacgcacaaacauccccaggaucugcucaaaaggcaagcgcacuguagaccuaggccaaugcggccuacucgggaccaucacaggaccaccacaaugcgaccaauuccuggaguucuccgcagaccucaucauagaacgccgcgaaggauccgacguaugcuacccgggcaaauucgucaacgaagaagcacuccgccagauacuacgcgagagcggcggaaucgacaaagaaaccaugggcuucacauacucggguauacgaaccaacggagugaccucagccugcaaacgcuccggcuccagcuucuacgccgaaaugaaauggcuacucagcaacacggacaacgcagccuucccacaaaugacaaaauccuacaagaacaccagaaaaucccccgccauaaucguauggggaauccaccacuccgucucgaccgcagaacaaaccaaacucuacggcucaggaaacaagcuaguaacagucggcuccuccaacuaccaacaaucauucguacccagccccggcgcgcgcccccaagucaacggccuaucuggacgaaucgacuuccacuggcucauccuaaacccgaacgacaccguuacauucucauucaacggggccuucaucgcaccagaccgagccagcuuucuacgaggcaaauccaugggcauccaaucggggguacaaguugacgcaaacugcgaaggggacugcuaccacagcggcggcacaaucaucagcaaucuacccuuccaaaacaucgacagccgagccguaggaaaaugcccacgcuacgugaaacaacgaucucuccuuuuagcaacuggcaugaaaaacguccccgagauccccaaagggagaggccuauucggagccauagccggcuucaucgaaaacggcugggaaggccuaauagacggcugguacggguucagacaccagaacgcccaaggugaaggaaccgcagccgacuacaaaagcacccaaucagcaaucgaccaaauaaccggaaaacuaaacagacucaucgccaaaaccaaccagcaauucgaacuaaucgacaacgaguucaacgaagucgaaaaacaaaucggcaacgucauaaacuggacccgggacucaaucaccgaaguguggucauacaacgccgaacuccugauagcaauggaaaaccaacacaccaucgaccucgcagacucagaaauggacaaacuguacgaacgcgucaaacgacagcuaagagaaaacgccgaagaagacgguacaggcugcuucgaaauauuccacaaaugcgacgacgacugcauggccuccauccggaacaacaccuacgaucaccgaaaauaccgcgaagaagccaugcaaaaccgcauccaaaucgaccccguaaaacucuccaguggauauaaagacguaauccuaugguucucauucggcgccuccugcuucauccuucucgccaucguaaugggccuggucuucaucugcgucaaaaacggcaauaugcgcugcacaaucugcauauaa

SEQ ID NO: 215825 - RNA, 1683 nt, Artificial Sequence
  derived and/or modified sequence opt from Influenza A H7N9 hemagglutinin
augaacauccaaauccuaguauucgcccuaaucgcaaucauccccaccgacgccgacaaaauaugccuuggacaccacgccguuucaaacggaacgaaagucaacacacugacagaacgcggaguagaagucgugaacgcgacagaaacaguagaaagaaccaacauaccccgaaucugcagcaaaggcaaacgaacggucgaccuaggccagugcggccuacugggaacuaucaccggcccaccccaaugcgaccaauuccucgaguucagcgcagaccucauaaucgagcgucgagaaggcuccgacguuugcuaccccggaaaauucguaaacgaagaagcacuaagacaaauccuaaggaaaagcggcggcaucgacaaggaagccaugggcuuuacauacuccggaauccgcaccaacggcgccaccagcgccugcagacgauccgggagcuccuucuacgcagaaaugaaauggcuccucagcaacacagacaacgcagccuucccacagaugacaaaauccuacaaaaacacaagaaaaucccccgcaaucauaguauggggaauccaccacagcgucagcacugcugaacaaaccaaacuauacggcucuggcuccaaacucguaaccguaggcagcucaaacuaccaacagagcuucguccccucaccaggugcacgaccccaagucaacggccucuccggccgaauagacuuccauuggcuuauacucaacccaaacgacacagucaccuucucauucaacggcgccuucauagcacccgaccgcgccuccuuucuacgagguaaaagcaugggcauccaauccgggguccaagucgacgccgacugcgaaggcgacugcuaccacagcggcggaacaauaaucagcaaccuccccuuccaaaacaucgacuccagagcaguaggaaaaugcccacgcuacgucaaacaaaggucccuccuccucgccaccggcaugaaaaacgugccagaaauacccaaaggcagagggcuauucggcgccaucgcaggcuucauagaaaacggaugggaaggccucauagacgggugguacggcuucagacaccagaacgcacaaggagagggcaccgccgccgacuacaaaucaacccaauccgcaauugaccagaucacgggcaaacuaaaccgccuaaucgagaaaaccaaccagcaauucgaacucaucgacaacgaguucauagaagucgaaaaacaaaucggcaacguaauaaacuggacacgagacagcaucacagaagucuggagcuacaacgccgaacuacugguagcaauggaaaaccaacacaccaucgaccuagccgacagcgaaauggacaaacucuacgaaagaguaaaaaggcaacuacgagaaaacgcagaagaagacggaaccggaugcuucgaaaucuuucacaaaugcgacgacgacuguauggcaagcauccgcaacaacaccuacgaccacagcaaguaccgugaagaagcaaugcaaaaccgcauccaaauagaccccgucaaacucuccuccggauacaaggacguaauccucugguucagcuucggagccagcugcuucauccuccccgccauaguaauggggcuaguauucaugugcgucaaaaacgggaacaugcgcugcaccaucugcauauaa

SEQ ID NO: 215826 - RNA, 1683 nt, Artificial Sequence
  derived and/or modified sequence opt from Influenza A H7N9 hemagglutinin
augaacacccagauccucgucuucgcccucaucgccauaauccccaccaacgccgacaaaaucugccuaggucaccacgccgucagcaacggaaccaaggucaacacccuuacagaacgcgggguagaagucgucaaugcaacagaaaccguugaacgaaccaacauuccucgcaucugcuccaagggcaagcgcaccgucgaccuaggccaaugcggacuccucggaaccauaaccgggcccccacaaugcgaccaguuccucgaauuuuccgcagaccucauaauagaacgacgcgaaggcagcgacguaugcuacccgggcaaauucgucaacgaagaagccuuacgacagauacuacgcgaaaguggaggaaucgacaaagaaaccaugggauucacauacaacggcauccgcaucaacggcgucacaucagccugcaaaagaucgggcagcagcuucuacgccgaaaugaaauggcuacucagcaacaccgacaacgccgccuucccccagaugaccaaauccuacaaaaacacacgaaaaagccccgccaucaucgucuggggcauccaccacuccgucagcacagcagaacaaacaaaacucuacggcuccggcaacaagcuaguaacagucggcucaucaaacuaccaacaaucauucguacccucccccggcgcccgcccgcaaguaaacggccuaucgggacgcauagacuuccacuggcuaauacuuaaccccaacgacacaguaacauucaguuucaauggcgcauucaucgccccagaucgcgccagcuuccuacgcgguaaaucuauaggcauccagagcggcguacaggucgacgccaacugcgaaggcgacugcuaucacuccggaggcaccaucauuagcaaccuacccuuccaaaacauagacucccgggcagucggcaaaugcccccgcuacgucaaacaacgcucacuccuccuagcaaccggcaugaagaacguacccgaaauccccaaaggacgaggcuuauucggcgcaauagccggauucaucgaaaacggaugggaaggccucaucgacggcugguacggauucagacaccaaaacgcccaaggggaagggacagcagccgacuacaaaagcacccaaucagccauagaccaaaucaccgggaagcucaaccgucucaucgccaaaacaaaccaacaauucgaacuaaucgacaacgaguucaacgaagucgagaaacaaaucggcaacgucauuaacuggaccagggacagcaucacagaagucuggucauacaacgcagaacuccucauagcaauggaaaaccaacacaccaucgaucucgcagacuccgagauggacaaacucuacgaacgaguaaaacgacaacuccgagaaaacgccgaggaagauggcaccggcugcuuugaaaucuuccacaagugcgacgacgacugcauggcaucgauccggaauaacacauacgaccaccgcaaauacagagaagaagccaugcaaaaccgcauacaaauagaccccgucaagcucucauccggauacaaagacgucauccucugguucuccuucggagccagcugcuucauacuccucgccaucgucaugggccucgucuucaucugcgucaaaaacggaaacaugagaugcacgaucugcauuuaa

SEQ ID NO: 215827 - RNA, 1683 nt, Artificial Sequence
  derived and/or modified sequence opt from Influenza A H7N9 hemagglutinin
augaacacgcaaauccuaguauucgcccucauagcaauaauccccaccaacgcggacaaaaucugccucggacaccacgcgguauccaacggcaccaaagucaacacccuaacagaacgaggcgucgaagucgucaacgccacagagacagucgaacgaaccaacaucccccgcaucugcuccaagggcaaacgcacaguagaccuaggccaaugcggccugcuaggaaccauaaccggcccaccccaaugcgaccaauuccucgaguucuccgccgaccucauaauagaaagacgugaaggcucagacguuugcuacccaggaaaguucgucaacgaagaagcccuaagacaaauccucagagaauccggcggcaucgacaaagaagcaaugggcuucacauacucgggcauccgcacaaacggagccacauccgcaugccgccgaucaggcuccuccuucuacgcagaaaugaaauggcuccucagcaacaccgacaacgcagccuucccccagaugacaaaauccuauaaaaacacaagaaagucaccggcacuaaucguguggggaauccaccacagcgucagcacugcagaacagacaaaacucuacggauccgggaacaagcuaguaaccguaggaaguucaaacuaccagcaaucguucguacccagucccggcgcacgcccccaagucaacggccucuccggacgcaucgacuuccacuggcucaugcucaaccccaacgacaccguaaccuucucauucaacggcgccuucaucgcacccgaccgagccagcuuccuccgaggcaaaagcaugggcauccaaucaggaguacaagucgacgccaacugcgagggggacugcuaccacagcggaggaacaauaaucagcaaccucccauuccaaaacauagacucccgagccgucggcaaaugcccccgcuacguaaaacagcgaucacuucuccuagccacgggaaugaaaaacgugccagaaaucccaaaaggaagaggccuuuucggagcaaucgcaggauucauagaaaacggcugggaagggcugaucgacgguugguacggcuuccgacaccaaaacgcccaaggagagggcaccgccgccgacuacaaaagcacacaaagcgccaucgaccaaaucacaggcaaacucaaccgacucauagagaaaacaaaccaacaauucgaacuuaucgacaacgaauuuaacgaagucgaaaaacaaaucggaaacgucauaaauuggacaagagacuccauaacagaagucuggucauacaacgcagaauuacucguagcaauggagaaccaacacacaauagaccuagccgacucagaaauggacaaacucuacgaacgaguaaaacgacaacugcgcgaaaacgcagaagaagacggaacaggaugcuucgagaucuuccacaaaugcgacgacgacugcauggcuagcaucaggaacaacacauacgaucacuccaaauaccgagaagaagccaugcaaaaccgaauccaaaucgacccagucaaacuaagcagcggcuacaaagacgugauccuuugguucuccuucggugccagcugcuucauacuccuagccauugucaugggccucgucuucaucugcgucaaaaacggcaauaugagaugcaccauaugcaucuaa

SEQ ID NO: 215828 - RNA, 1683 nt, Artificial Sequence
  derived and/or modified sequence opt from Influenza A H9N2 hemagglutinin
auggaaaccgucagccuaaugaccauacuccuccuaguaaccacaucaaacgcagacaaaaucugcauuggacaucaauccaccaacuccacagaaacagucgacacccuaaccgaaacaaacguccccguaacccacgccaaagagcuccuacacacggaccacaacgggaugcucugcgcaacaaaccugggacacccacucauccucgauaccugcaacguugaaggacuaaucuacggcaacccauccugcgaccuacuccucggaggccgcgaauggucguacauuguagaacgccccuccgccguaaacggaacaugcuacccaggcaacguggaaaaccucgaggagcuacgcacccucuucucauccucuucauccuaccaacgcauacaaauauucccagacaccaucuggaacguaaccuacacgggcaccagcaaaagcugcucugacagcuucuaccgaaacaugagauggcuaacgcaaaagaacggccucuaccccguacaagacgcccaauuuaccaacaaccggggcaaagacauccucuucguauggggaauacaccacccacccacugacaccgcccaaaccaaccuauacacccgcaccgacaccacaaccucagucaccaccgaaaaccucgaccgaacauucaaaccccucauaggaccccgcccccuagucaacggacucauaggucgcaucaacuacuacugguccguccuaaaacccggacaaacccuucgagugcgaagcaaugggaaccucaucgcucccugguauggccacguccucucgggcgaaagccacggaaggauccuuaaaacuaaccuaaacucaggcaacugcguaguccaaugccaaacagaaaagggaggccuaaacuccacccuccccuuccacaacaucuccaaauacgccuucggcaauugccccaaauacaucggagucaaaagccucaaacuggcaaucggccuacgcaacgucccagcaaaaucgucgcgcggccucuucggcgcaaucgccggcuucaucgaaggaggauggcccggcuuagucgccgguugguacggauuccaacauucaaacgaccaaggcgucgggauagccgccgacagagugagcacacaaaaagcaguagacaaaaucaccagcaaagucaauaacaucgucgacaagaugaacaaacaauacgaaaucauagaucacgaguucuccgaagucgaaacccgauuaaauaugauaaauaacaaaaucgacgaccaaauccaagacgucugggcauacaacgccgaacuacuuguacuacuagaaaaccagaaaacgcucgacgaacacgacgcgaacguuaacaaccucuacaacaaagucaaaagagcccuaggcucaaacgcacuagaagacggcaaaggcugcuucgaacuauaccacaaaugcgacgaccaaugcauggaaaccauccgcaacggcaccuacaaccgccgcaaauaccaagaagaaucaagacucgagcgacagaaaaucgaaggcauaaaacuagaauccgagggaacuuacaaaauccucaccauauacucgaccgucgcauccucccucguccuagccaugggcuucgccgccuuccucuucugggccauguccaacggcuccugccgcugcaacaucugcauauga

SEQ ID NO: 215829 - RNA, 1695 nt, Artificial Sequence
  derived and/or modified sequence opt from Influenza A H9N2 hemagglutinin
auggaaaaaaucguccuacuacuagccauagccucacucgugaaauccgaccagaucugcauaggauaccacgccaacaacucaaccgaacaaguagauacaaucauggaaaagaacguaaccgucacucaugcacaagacauccuggaaaaaacacacaacggaaaacugugcgaccucgacggcgucaaaccccuaauacuccgugacugcuccguagccggauggcuacuaggcaacccuaugugcgacaaauucaacgacguccccgaaugguccuacauagucgagaaagccaaccccgccaacgaccucugcuaccccggcaaccucaacgacuacgaagaacucaaacaucuccuaucucgaaucaaccacuucgaaaaaauccaaacauucccgaaaagcuccugguccgaccacgaagcaucccuaggagucuccgcggccugcccauaccaaggaaugcccuccuucuuccgcaacguaguauggcucauaaaaaaaaacaacaccuacccgacaaucaaaucaucauacaacaacacaaaccaagaagaccuccucauccuauggggaauucaccacucaaacgacgaagcagaacaaacccgccucuaccagaacucaaauaccuacauauccgucggcaccucaacacucaaccaacgccucguacccaaaaucgccacccgcucaaaaguuaacggccaauccggccgcauggacuucuucuggaccauacuuaaacccaacgacgcaaucaacuucgaauccaacggcaacuucaucgccccggaauacgccuauaaaaucgucaagaagggcgacucggccaucaugaaauccgaggucggauacggcgacugcaacaccaaaugccaaacuccaaucggcgcaaucaacuccucuaugccauuccacaacauccacccccucaccaucggcgaaugccccaaauacguaaaguccaacaaacucguccucgccaccggccuccgcaacucaccccaaaucgagacccgcggccucuucggagcaaucgccggcuucaucgaaggaggauggcaaggcauggucgacgguugguacggauaccaccacagcaacgaacaaggcuccgguuacgcggcugacaaagaauccacgcaaaaggccauagacggcgucaccaacaaagucaacuccauaaucgacaaaaugaauacccaauucgaagcagucgagcgagaauucaacaaccucgaacgacgcaucgaaaaccucaacaaaaaaauggaagacgguuuccuagacguguggaccuacaacgccgaacuccucguccucauggaaaacgaacgcacccuagacuuccacgacucaaacguaaaaaaccucuacgacaaaguccgacuccaacuacgcgacaacgcaaaagaauuaggcaacggcugcuucgaauucuaccacaaaugcgacaacgaaugcauggaauccguccguaacggcaccuacgacuacccccaauacagcgaagaagcaagacuaaaaagggaagagaucagcggcgucaaacucgaaucaaucggaaccuaccaaauccucagcaucuacuccacaguagcauccucacucgcccuugcaauaaugguagccggccucucccucuggaugugcuccaauggcucccuccaaugccgcauaugcaucuga

SEQ ID NO: 215830 - RNA, 1683 nt, Artificial Sequence
  derived and/or modified sequence opt from Influenza A H9N2 hemagglutinin
auggaagcaaucccacucaucacaauacuccuagucgucaccgcaagcaacgccgacaagauaugcauaggcuaccaauccaccaacaguaccgaaacaguagacacccucaccgaaaacaacguaccagucacgcacgccaaagaacuccuccacaccgaacauaauggcaugcuaugcgcaacaaaccucggucgaccgcucauacucgauaccugcaccauagagggucucauauacggaaacccaucuugcgaccuccuccucggaggccgcgaauggucauauaucguagagcggcccuccgcggucaacggcaugugcuacccaggcaauguagaaaaucuagaagaacuccgaucauucuucucguccgccuccagcuaccaacgcauacagaucuucccagacaccaucuggaacgucucauacuccggcaccaguaaggcuugcagcgacucauuuuaccgaagcaugcgcuggcuaacucagaaaaacaacgcauacccaauacaagacgcacaauacacaaacaaccgcgggaaaucaauccuuuucauguggggcaucaaccacccacccacagacacugcacaaaccaaucucuacaccagaacagacaccacaacaucagucgccacagaagacaucaaccgcacauucaaacccgucauaggcccccgcccccuagucaauggacuccaaggacgcaucgauuacuacugguccguacucaaacccggccaaacccuucgcguacgauccaacggcaaccucauagcgccgugguacggccacauacuaucaggagaaagccacggacgcauccugaaaaccgaccucaacucaggcucaugcgucguccaaugccaaacagaacgcgggggccuaaacaccacccuacccuuccacaacgucuccaaauacgcauucggcaacugccccaaauacgucggagucaagucacucaaacucgccguaggacuacgaaacguccccgcccgaucaucccgaggacucuucggcgccauagcgggauucaucgagggagggugguccggccuaguagccggaugguacggcuuccagcacuccaacgaccaaggcguuggcaucgccgccgaccgcgacagcacccaacgggcaauagacaaaauaaccagcaaagucaacaacaucgucgacaaaaugaacaagcaauaugaaauuaucgaccacgaguucuccgaagucgaaaaccgccucaacaugaucaacaacaagauagaugaccaaauccaagacaucugggcuuacaacgcugaacuauuaguccuacuugaaaaccagaaaacccucgacgaacacgacgccaacgucaacaaccucuacaacaaagucaaacgcgccuuaggaagcaacgccauggaagacggcaaaggcugcuucgaacuauaccacaaaugcgacgaccaaugcauggaaacuauacgcaacggaacauacaaccgccgaaaauacaaagaagaaucacgucucgaaagacagaaaaucgaaggcguaaaacuagaaagcgaaggcacauacaaaauccucaccaucuacuccaccguagcauccucacucgucaucgcaaugggcuucgccgcguuccucuucugggccaugagcaacgguucguguaggugcaacauaugcaucuaa

SEQ ID NO: 215831 - RNA, 1683 nt, Artificial Sequence
  derived and/or modified sequence opt from Influenza A H9N2 hemagglutinin
auggaaaccguaucccuaaucaccauccucuuagucgccacagucucgaacgccgauaaaauaugcaucggauaccaaucaacaaacuccacggaaaccgucgacacccuaaccgagaacaacguaccaguaacacacgcaaaagaacuacuccacacagaacacaacggcaugcucugcgcaaccucccugggccaaccacucauccucgauaccugcacgaucgagggacucaucuacggaaaccccagcugcgaccuccuccucgaaggccgagaaugguccuacaucguggaacgccccuccgcaguaaacggccucugcuacccuggaaacguagaaaaucuugaggaacuccgcucccucuucucauccgcccgaagcuaccaacgaauccaaaucuucccggacacaaucuggaacgucuccuacaacggcaccuccaaggccugcagcggcuccuucuaccgcuccaugcgcuggcucacacguaaaaacggagacuacccuauacaagacguccaauacacgaacaaccaaggcaaaaacauccucuucauguggggcaucaaccacccgccaacagacaccacacaacgcgaccucuacacacgcaccgacaccaccacauccguugccacagaagaaaucaaccgaaucuucaaaccccuaaucggcccccgcccacuggucaacggccucaugggccgaauagacuacuacugguccguacucaaacccggccaaacccuccgaaucaaauccgacggaaaccugaucgcucccugguacggacacauacucucaggcgaaucacacggacgaauccuaaaaaccgaccucaaacgaggaagcugcacggugcaaugccaaaccgaaaaaggcggccucaacaccacucucccguuccaaaacguauccaaauacgccuucggaaacugcuccaaauauaucggaauaaagucccucaaacucgcaguaggacuucgcaacguacccagccgaaguucccgcggccucuucggcgcaauugccggauucaucgaagguggcuggucgggccucgucgcaggcugguacggcuuccaacacucuaacgaccaaggcgucggaauggccgcagaccgcgacuccacccaaaaagcaaucgacaaaaucaccucgaaagucaacaacauagucgauaagaugaacaaacaauacgaaaucauagaccacgaauuuuccgaaguggaaacccgacucaacaugaucaacaacaagaucgacgaccaaauacaagacaucugggcauacaacgccgaacuccucguccuacucgaaaaccagaaaacccuagacgaacacgacgcaaacgucaauaaccuauacaacaaagucaaacgagcccucggcuccaacgccguagaagacggcaaaggaugcuuugagcucuaccacaagugcgauaaccaaugcauggaaaccauccgcaacggaaccuacaacaaacgcaaguaccaagaagaauccaagcuagaacgccagaaaauagaaggcgucaaacucgaauccgaaggcacuuacaagauccuuaccaucuacucaacugucgccucaucccucgucauagcaaugggcuucgccgcauuccuauucugggccauguccaacgguuccugccgcugcaacauaugcauauaa

SEQ ID NO: 215832 - RNA, 1683 nt, Artificial Sequence
  derived and/or modified sequence opt from Influenza A H9N2 hemagglutinin
auggaaaccauuucacucaugacaauccuccucaucacaacagcauccaacgcagacaaaaucugcauuggucaccagaguaccaacuccacugagaccgucgacacccucaccgaaaccaacguuccaguaacccacgccaaagaacuccuccaaaccgaacacaacggcaugcugugcgccaccaaccugggccacccccuaauacucgauaccugcacaaucgaaggccucauauacggcaaccccaguugcgaccuccuccucgaaggccgcgaauggagcuacaucguagagcgccccucggcagucaacggcacaugcuaccccgguaacgucgaaaaccucgaagaacucagaacacucuucagcuccgccagcucauaccagaggauccagaucuuccccgacacaacauggaacgucaccuacaccggcaccucccgaagcugcucaggcagcuucuaccguucaaugcgcuggcuaacccagaaaagcggauucuaucccguccaagacgccaaauacaccaacaaccgagggaaaaacauccucuucgucuggggaauacaccacccucacaccuacacagaccaaaccacccuguauauccgcaacgacaccaccacaucagucacaaccgaagaacugaaccgcauauucaaaccagucaucgucccacgccuccuuguaaacggccaacaaggccgaaucgacuacuacugguccguccuaaaacccggacaaacccugcgaguucgauccaacggaaaccugaucgcccccugguacggacauguccuauccgguggaucccacggccgcauccuuaaaacagaccugaagucuggcaacugcguuguacaaugccaaaccgaaaagggcggccuaaacucaacacuccccuuccacaacaucucaaaauacgccuucggcacuugcccaaaauacguaaaaguuaacagccuaaagcuagccaucggccuccgcaacguaccggcccguuccaaccgaggacuauucggcgccaucgccggauucauugaaggcggauggccaggacucgucgccggcugguacggcuuccaacacuccaacgaccaaggugucggaauggcggcagacagagacuccacacaaaaagccguagacaaaaucacaagcaaagucaacaacaucgucgacaagaugaacaaacaauacgaaaucauugaccacgaguucucugaaguagaaacccgcuuaaacaugaucaacaacaaaaucgacgaccaaauccaagacgucugggccuacaacgccgaacuucuaguccuacuagaaaaccagaaaacacuagacgaacacgacgcgaacguaaacaaccucuacaacaaaguaaaacgcgcccucggauccaaugccauggaagaugggaagggcugcuucgaacuauaucacaaaugcgacgaccaaugcauggaaaccauccgcaacggaaccuacgaccgccgaaaauaccgcgaagaaagccgccucgaacgccaacgaaucgaaggaguaaaacucgaauccgaaggaacauacaaaauacucaccaucuacucgacaguggcaagcucccuagugaucgcaaugggauuugccgccuuccucuucugggcuauguccaacggcuccugccgcugcaacaucugcaucuaa

SEQ ID NO: 215833 - RNA, 1683 nt, Artificial Sequence
  derived and/or modified sequence opt from Influenza A H9N2 hemagglutinin
auggaaacaguaagccuaauaacuauccuccucguagccacuguaagcaacgccgacaaaaucugcaucggcuaccaaucaacaaacucaaccgaaaccguugacacccuaaccgaaaacaacguacccguaacccacgcgaaggaacuccuacacaccgaacacaacggcaugcucugcgcaacaucccucggacaaccacucauccucgauaccugcacaaucgagggucucaucuacgggaacccaagcugcgaccuaucccuggaaggccgcgaauggucauacaucgucgaacgccccuccgcagucaacggccucugcuacccagguaacguagaaaaucucgaagaacuacgaagccuuuucagcuccgcacgauccuaccaacgcauccaaaucuuccccgacaccauauggaacgucagcuacgacgguacauccaccgccugcucgggcucauucuaccgcuccaugagauggcugacacgcaaaaacggagacuacccaacccaagacgcccaauacaccaacaaccaaggcaaaaauauccuauucauguggggcaucaaccacccacccacugacgacacacaacguaaccucuacacgcggacagacaccaccaccuccgucgccaccgaagaaauaaaccgcaucuucaaaccccucaucggcccacgaccccucguaaacggauugaugggccgaauagacuacuacuggucuguucucaaaccaggacaaacucuccgcauaaaauccgacggcaacuuaauagcgcccugguacggacacauacucuccggugaaucgcacggaagaauacucaaaaccgaccuaaaacgaggcuccugcaccguacaaugccaaacagagaagggcggccuaaacaccacacuaccauuccaaaacguaucgaaauacgcuuucggaaacugcuccaaauacaucggcaucaaaagccucaaacucgcagucggccuucggaacgucccauccagauccagccgcggacuauucggcgccauagccggauucauagaaggcggcuggucgggccucguagccggaugguacggcuuccaacauuccaacgaccaaggcgucggcauggcagccgacagagacucuacgcaaaaagcaauagacaaaauaacaucaaaagucaacaacauugucgacaaaaugaacaaacaauacgaaaucauagaccacgaguucucugaaguagaaacacgccucaacaugaucaacaacaaaaucgacgaccaaauccaagacaucugggccuacaacgcagaacuccuaguccuccuggaaaaccaaaagacacucgacgaacacgacgcaaacgucaacaaccuauacaacaaagucaaacgcgcccucggauccaacgccgucgaagacggaaaaggcugcuucgaacuuuaccacaagugcaacgaccaaugcauggaaacaauacgcaacggcaccuacaaccgccgaaaauaccaagaagaguccaaacuugaacgacaaaagaucgaaggcgucaaacucgaauccgaaggaacguacaaaauacuaacaaucuacucaaccgucgcaucaucccuaguaaucgccaugggauucgccgccuuccucuuuugggccaugucaaacggcucaugccggugcaacauaugcaucuaa

SEQ ID NO: 215834 - RNA, 1683 nt, Artificial Sequence
  derived and/or modified sequence opt from Influenza A H9N2 hemagglutinin
auggaaacagucucacucaucacaauacuccucgucgcaaccgucuccaacgccgacaaaaucugcaucggauaccaauccaccaacucuaccgagacagucgacaccuuaaccgaaaacaacguuccggucacacacgccaaagaacuccuccacaccgaacacaacggaaugcuaugcgccaccucacucggccaaccgcucauacucgauaccugcacaaucgaaggccucaucuacgguaaccccucgugcgacuuaucacuagaaggacgcgaaugguccuacaucguagaacgccccagcgcagucaacggucuauguuaccccggaaaugucgaaaaccucgaagaacuccgcucguuauucagcuccgcccgcucauaccaacggauccaaauauuccccgacaccaucuggaacguaucguacgacggaaccuccaccgccugcagcggauccuucuaccgauccaugcgcuggcugacccgcaagaacggagacuaccccacacaagacgcacaauacacaaacaaccaaggcaaaaacauauuauucauguggggaaucaaccacccgcccacggacgacacacaacgcaaccucuauacacgcaccgacaccacgacaucaguagccaccgaagaaauaaaccgaauauucaaaccccucauaggaccacgcccccuaguaaacggccucaugggacgcaucgacuacuacugguccguccucaaaccaggccaaacccuccgcaucaaaucagacggaaaucuaauagccccaugguauggccacauacucucaggagagucccacggacgcauccugaaaaccgaccucaaacgcggcucgugcacgguccagugccaaacugaaaaaggcggccugaacaccacgcuccccuuucaaaacgucuccaaauacgcauucggcaacugcuccaaauacaucggaaucaaaagccugaagcuagccgugggacuaagaaacgucccauccagauccagccgcggacucuucggcgccaucgccggcuucaucgaaggcggauggucaggccuagucgccggcugguacggauuccaacacucaaacgaccaaggcguuggaauggccgccgacagagacuccacccaaaaggcaauagacaagaucacauccaaagucaacaacaucgucgacaaaaugaacaaacaguacgaaaucaucgaccacgaguucuccgaagucgaaacccgacucaacaugaucaacaacaaaaucgacgaucaaauccaggacaucugggccuacaacgcagaacuccuaguccuacucgaaaaccagaaaaccuuagacgagcacgacgcaaacgucaacaaccuauacaacaaaguaaagcgcgcacucggaucaaacgccguagaagacggaaagggcugcuucgaacuauaccacaaauguaacgaccaaugcauggaaaccauaaggaacggcaccuauaaccgacgcaaauaccaggaagagagcaaacucgaacgacagaaaaucgaaggcguuaaacucgaguccgagggcacauacaaaauccucaccaucuauucaacaguagccuccucccucgucaucgcuaugggcuucgcagccuuccuauuuugggccaugagcaacggcucgugccgcugcaacaucugcaucuag

SEQ ID NO: 215835 - RNA, 1683 nt, Artificial Sequence
  derived and/or modified sequence opt from Influenza A H9N2 hemagglutinin
auggaaacagucucacucaucaccauccuccuaguugcaaccgucuccaacgccgacaaaaucugcaucggcuaccaauccacuaacagcacagaaaccgucgauacacuaacagagaauaacguccccgucacccacgcaaaagaacuacugcacaccgaacacaacggcaugcuaugcgccaccucacucggccaaccccucauccucgauaccugcaccauagagggccucaucuacggaaaccccuccugcgaccucucccucgaaggccgagaaugguccuacaucgucgaacgccccagcgccgucaacggacuaugcuaccccggcaacgucgaaaaucucgaggaacuccgcucacuauucuccuccgcccgcagcuaccaacgaauccaaaucuuccccgacaccauuuggaacguaucauacgacggcacaagcacagccugcuccgggagcuucuacagauccaugcgauggcucacacgcaagaacggcgacuacccaauccaagacgcccaauacaccaacaaccaaggcaaaaacauucucuucauguggggcaucaaccaucccccuaccgacaccacccaacgcgaccucuacacccgcacagacaccacgaccuccguagcaacagaagaaaucaaccgcauuuuuaaaccccucaucggcccccgcccccucgucaacggacuaaugggccgcauagacuacuacuggagcguccucaaaccaggccaaacccugcgcauuaaaucagacggaaaccucauagcccccugguucggccacauccucuccggagaaucccacggacgaauccuaaaaaccaaccugaaacgcggcagcugcacaguacaaugccagacagagaaaggcggacucaacacuacccuccccuuccaaaacgucucaaaauacgccuucggcaacugcuccaaauacauaggcaucaaaagccucaaacucgccguaggccuacgaaacguccccucgcgcucaagccggggccuauucggcgcaauagcuggcuucaucgaaggcggguggagcggccucgucgccggcugguacggcuuccaacauagcaacgaccaaggcgucggaauggcagcagaccgagacucaacccaaaaagccaucgacaaaaucacauccaaagucaacaacauagucgacaaaaugaacaagcaauacgagauaauagaccacgaguucucagaaguggaaacacgccucaacaugaucaacaacaagaucgacgaccaaauccaagacauaugggcauacaacgccgaauuacucguccuucucgaaaaucagaaaacccuagacgaacacgacgccaacgucaacaaccucuacaacaaagucaaaagagcccugggcuccaacgccguugaagauggcaaaggcugcuucgaacuauaccacaagugcgacgaccaaugcauggaaaccauccgaaacgguaccuacaaccgcagaaaauaccaagaagaauccaaacuagagcggcagaaaauagaaggaguaaagcucgaaagcgaaggcacauacaaaaucuugaccauauacucaaccgucgccuccucgcucgucaucgccaugggcuucgccgcauuccucuucugggccauguccaacggcuccugccgaugcaacaucugcaucuaa

SEQ ID NO: 215836 - RNA, 1758 nt, Artificial Sequence
  derived and/or modified sequence opt from Influenza B hemagglutinin
augaaagcaaucauaguccuccucaugguaguaaccuccaacgccgaccgcaucugcaccggcauaacauccucgaacaguccccacgucguaaaaaccgccacacaaggagaagucaacguaaccggcguaaucccccuaaccacaacccccacaaagucccacuucgcaaaccugaaaggcaccgaaacacgcgguaagcucugucccaaaugccuaaacugcaccgaucuagacgucgcucucggccgcccaaaaugcacugguaaaauacccuccgcaagagucucgauccugcacgagguccgacccgucacauccggaugcuuccccaucaugcacgaccgcaccaagauacgccaacucccgaaccuccuccguggcuacgaacacauccgccuaucuacccacaacgucaucaaugcagaaaacgcacccgguggccccuacaaaaucggcacaucgggcuccugcccaaacaucaccaacggcaacggcuucuucgcgaccauggcaugggccguccccaaaaaugacaaaaacaaaaccgcuacaaacccccucacaaucgaaguucccuacauaugcaccgaaggcgaggaccaaauaaccgucuggggcuuccacagcgacaacgaaacccaaauggccaaacuauacggggacuccaaaccccaaaaauucacauccucagccaacggagugaccacacacuacgucucccaaaucggaggauuccccaaccaaaccgaagacggcggacucccacaaagcggccguauagucgucgacuauaugguacaaaaauccgguaaaacaggcacaaucaccuaccaacgaggcauccuccucccacaaaaaguauggugcgcaucagggcgcucgaaagucauaaaaggcucccucccgcucauaggcgaagccgacugcuuacaugagaaauacggcggccuaaacaaaucaaaaccauacuacacaggcgaacacgcuaaagccauugguaacugccccaucugggucaaaacaccacucaagcucgcaaacggaaccaaauaccgaccacccgcaaaacugcucaaagaacgcgguuucuucggagccauagccgguuuccuagaaggagguugggaaggaaugaucgcgggauggcacggauacacaagccacggagcacacggcguagcaguagcagcagaccucaaaagcacacaagaagccauaaacaaaauaaccaaaaaccuaaacagccuaagcgagcucgaggucaaaaaccuccaaagacucucuggcgcaauggacgaacuacacaacgaaauccucgaacucgaugagaaggucgacgacuuacgggccgacaccaucuccagccaaaucgaacucgccguccuccucucaaacgaaggcauaauaaacagcgaagacgagcaccuucucgcccuagaacgcaaauuaaagaaaaugcucggaccaucggccguagaaauaggaaacggcugcuucgaaaccaaacacaaaugcaaccaaacaugcuuggaccgcauugccgcagggaccuucgacgccggcgaguucagccuccccaccuucgacucacuaaacaucaccgcagccagccugaacgaugacggccucgacaaccacacaauccuccuauacuacagcacagccgcgaguucgcuagccgucacccucaugauagcuaucuucguuguauacaugguuucccgcgacaaugucuccugcagcauaugccucuag

SEQ ID NO: 215837 - RNA, 1758 nt, Artificial Sequence
  derived and/or modified sequence opt from Influenza B hemagglutinin
augaaagcuauaaucguccuacucauggucgugacaucuaacgccgaccgaaucugcacaggaauuacgucaucaaacucuccccacgucgucaaaacagcuacucaaggcgaagugaacguaaccggagucaucccucugacaacgacacccaccaaaucccauuucgcaaaccucaaaggaaccgaaacccgcggaaagcuaugcccaaaaugccugaacugcaccgaccucgacgucgcccucgggcgccccaaaugcaccggcaaaaucccaucggcccgugucucgauccuucacgaaguaagacccguaacaucaggaugcuuccccaucaugcacgaccgcacaaaaauacgacaacuccccaacuuacucaggggauacgagcacauccgucuaucaacccacaacguaaucaacgccgagaacgcgccaggcggcccguacaagaucggaaccucgggcuccugcccaaacaucaccaacggcaacggcuucuucgcgaccauggccugggcaguccccaaaaacgacaaaaacaagacggcaacaaacccucuaacgauagagguccccuacaucugcaccgaaggagaagaccaaauaaccgucuggggguuccacuccgacagcgaaacucaaauggcaaaacuuuacggagacuccaagccccaaaaauucaccagcuccgccaacggcgucaccacccacuacguaucucaaaucggcggcuucccgaaccagaccgaagacggcggcuuaccccaaagcggccgaauagucguggacuacaugguccaaaaauccggaaaaacgggaacaauaacauaccagcgcggcauacuacuaccacaaaaagucuggugcgcaagcggccgauccaaagugaucaagggcucucucccccucaucggcgaggccgacugccuccacgagaaauacggcgggcuaaacaaaucgaaaccauacuacaccggagaacacgccaaagcaauaggcaacuguccaaucugggucaaaacgccccucaagcuggcaaacgggaccaaauaccgacccccggccaagcuccucaaagaacgcggauucuucggagccauagcgggcuuccuagaagguggcugggaaggcaugaucgcuggcuggcacggauacacaagccauggagcacacggcgucgcagucgccgccgaucuaaaauccacacaagaggcaaucaacaaaaucaccaaaaaccucaacagccuaagcgagcuagaagucaaaaaccuccaacgccuaucaggagccauggacgaacuccacaaugaaauacucgaacuagacgagaaagucgacgaccuccgagcggacacaaucucgagccaaaucgagcucgccguccugcucuccaacgaaggcauaaucaacucggaggacgagcaccuacucgcacuagagaggaagcuaaagaaaaugcucgggccaucggccguagaaauuggcaacggcugcuucgagacaaaacacaaaugcaaccaaacuugccuugaccgcaucgcagccggaaccuuugacgccggagaguuuucccucccaaccuucgacucgcucaacauaacagccgcaagccuaaacgacgacggccucgacaaccacaccauacuacuguacuacagcacagccgccagcucacucgcagucacccucaugauagcgaucuucgucgucuauauggucucacgagacaacguaagcugcuccauaugccuguga

SEQ ID NO: 215838 - RNA, 1758 nt, Artificial Sequence
  derived and/or modified sequence opt from Influenza B hemagglutinin
augaaagccaucauagucuuacucaugguaguaaccuccaacgcagaccgaauauguacaggcaucaccagcucaaacucaccgcacgucgucaaaacagccacgcaaggcgaaguaaacgucacaggcguaauaccccucacaacuaccccaacaaaaagccacuucgcaaaccuaaaaggcaccgaaacuaggggcaaacuaugcccaaaaugccucaacugcaccgaccuagacgucgcacuaggucgccccaaauguaccggcaaaauaccaucagcccggguuucgauccuacacgaagucagaccagucacauccggaugcuuccccauaaugcaugaccgaaccaaaauucgacaacuaccaaaccuacuucgaggauacgaacauaucaggcucucgacacauaacguaaucaacgcugaaaacgcacccggaggacccuacaagaucggcaccucgggaucaugcccaaacauaaccaacggcaacggcuucuucgccaccauggccugggccguacccaagaacgacaagaacaagacagccacaaacccccucacaaucgaggucccauacaucugcaccgaaggagaagaucaaaucacugucuggggauuccacagcgacaacgaggcccaaauggccaaacucuacggcgacucaaaaccccaaaaauucaccuccucggccaacggcgucaccacccacuaugucagccaaaucggaggcuucccaaaccaaaccgaggacggcggucugccacaaagcggccguaucgucgucgacuacaugguacaaaaguccggaaaaaccggaacaaucacauaccaaagagggauccuacuaccacagaaaguuuggugcgcgagcggcagaucgaaagucaucaaaggaucccuuccacucaucggagaggcagauugccuccacgaaaaauacggaggacucaacaaaucgaaaccauacuacaccggagaacacgccaaagccaucggcaacugccccaucuggguaaaaaccccacucaaacucgcgaacggaaccaaguaccgacccccggcaaaacuccugaaagagcgcggauucuucggcgcaaucgccggauuccucgaaggcggcugggagggcaugauagcaggcuggcacggauacacuucacacggcgcgcacggagucgcggucgcagcugaccucaaauccacccaagaagccaucaacaagaucaccaaaaaccucaacagccugagcgaacucgaagugaaaaaccuccaacgacucaguggcgcaauggacgaacuacacaacgaaauacucgaauuagacgaaaaaguagacgaccugcgcgcagacacaauaucaucccaaauagagcuggcgguccuacucuccaacgaaggaaucauaaacuccgaggacgagcacuuacucgcacucgaacgcaaacuaaagaaaaugcucggcccaucagcaguagagaucggaaacggcugcuucgaaacaaaacacaaaugcaaucaaacaugccuugacagaaucgccgcaggaaccuucgacgccggcgaguucucacuaccgaccuucgacucccuaaacaucaccgcagccagccuaaacgacgacggccuagacaaccacaccauacuccucuacuacuccacagccgccagcucgcuggccguuacccucaugaucgcuauauucgucgucuacaugguaucgcgcgacaacgugagcuguagcauaugccuauaa

SEQ ID NO: 215839 - RNA, 1758 nt, Artificial Sequence
  derived and/or modified sequence opt from Influenza B hemagglutinin
augaaagccaucauagucuuacucaugguaguaaccucgaacgccgacagaauaugcaccggaaucaccaguuccaacuccccacacguagugaaaacggccacacaaggagaaguaaacgucaccggcgucaucccccucaccacaacaccgaccaaaucccacuucgcaaaccuaaaaggaaccgaaacccgcggcaaacuaugccccaaaugccuaaacugcacagaccucgauguagcccuaggccgaccaaaaugcaccggcaaaauccccuccgcacgcguaucaauacuccacgaaguucgccccguaaccucaggcugcuuccccauaaugcacgaucgcaccaaaauccgacagcuaccgaaccuacuaaggggcuacgaacacauccgccucucaacacacaacguaaucaacgccgaaaacgcacccggcggacccuacaagaucggcacaucgggcucgugcccaaacauaaccaacggcaacggcuucuucgccaccauggccugggcaguccccaaaaacgacaaaaacaaaaccgccacaaacccgcucacgaucgaaguccccuacaucugcacggaaggcgaagaccaaauaaccguguggggccuccacuccgacaacgagauccaaauggcaaaacuauacggcgacucuaaaccacaaaaauucacaaguucggcaaacggcgucaccacacacuauguuucgcaaaucggcggcuuccccaaccaaacugaggacggcggccugccccaaagcggacguaucgucguagacuacauggugcaaaaauccgggaagacgggaacaaucaccuaccagagagggauacuacucccacaaaagguguggugcgccagcggacgaucgaaaguaauaaagggcucacucccucuaauaggcgaggccgacugccuccaugagaaauauggcggccuaaacaaaucaaaaccauacuacaccggugaacacgccaaagcaauaggcaacugcccgaucugggucaaaacaccccucaagcucgcaaacgggaccaaauaccgcccaccagccaagcuccucaaagaacgcggguucuuuggcgcaaucgccggcuuccuagagggcggaugggaaggcaugauagccgguuggcacggcuacaccagccacggggcacacggggucgcagucgcagcugaccucaaaagcacccaggaagccaucaacaaaaucaccaaaaaccucaacagccucagcgaacucgaagucaaaaaccugcaacgacuaucgggcgccauggacgaacuacacaacgaaauacuagagcucgacgaaaaaguugacgaccuacgcgcagacaccaucucgucccagaucgagcucgccguccuccucucaaacgaaggcauaauaaacucagaagacgaacacuuacucgcgcuagaacggaaacuuaagaaaaugcucgggcccuccgccguagaaaucggcaacggcugcuucgaaaccaaacauaaaugcaaccaaacaugccuagaccgcaucgcagcgggaaccuucgacgcgggugaguucucacucccaaccuucgacucacuaaacaucacugcagcuucccugaacgacgacggccuagacaaucacacaauacuccucuacuauagcaccgcagccagcucgcuagcagucacacuaaugaucgcgauauucgucgucuacaugguaucaagagacaacguauccugcagcaucugccucuaa

SEQ ID NO: 215840 - RNA, 1758 nt, Artificial Sequence
  derived and/or modified sequence opt from Influenza B hemagglutinin
augaaagcgauaaucguccuccucauggucguaacaucgaacgccgaccgaauauguacuggaaucacaagcucuaacuccccacacgucguaaaaacugcgacccaaggcgaaguaaacgugaccggcguaaucccccucaccaccaccccaaccaaaucccauuucgccaacuuaaaaggaaccgaaacccgcggaaaacucugucccaaaugccuuaacugcacagaccucgacgucgcccucggacgcccaaaaugcaccgggaagauacccucagcccgcguaagcauccuccaugagguccgcccuguuaccuccggcugcuucccgaucaugcacgaccgaaccaaaauccgacagcuaccaaaccuacuccgcggauacgaacacauccgacuauccacccacaacguaaucaacgccgaaaacgcccccggaggacccuacaagaucggaaccuccggcuccugcccuaacaucaccaacggcaacggcuucuucgcaaccauggccugggccguccccaaaaacgacaaaaacaaaacagcaaccaauccgcucacaaucgagguacccuacaucuguaccgaaggagaagaccagaucaccgucuggggauuccacagcgacaacgaaauacaaauggcaaaacucuacggagacucaaaaccgcagaaguucaccuccuccgccaacggcgucaccacccacuacgucucacaaauaggaggauucccaaaccaaaccgaggacggcgggcugccccaaucugggcgcauaguaguugacuacaugguucaaaaaucaggcaaaacuggcacaauaacauaccaacgcggcauauuacuaccccaaaaagucuggugcgcauccggacgcuccaaagucaucaaaggcucccucccgcuaaucggagaagccgacugccuccacgaaaaauacggaggacuaaacaaaucaaaacccuacuacaccggcgaacacgccaaagccaucggcaacugcccaaucuggguaaaaacaccccuaaaacuagcuaacggaaccaaauaccgaccaccagcaaaacuccugaaggaacgcggcuucuucggugcuaucgccggcuuccucgaaggcggcugggaaggaaugaucgcgggguggcacggcuacaccucccacggagcgcacggagucgcgguagccgccgaccucaaaaguacccaagaagcaaucaacaaaaucacgaaaaaccucaacucucuguccgaacucgaagucaaaaaccuucaaagacucucaggagcaauggacgaacuucacaacgaaauacucgagcuagacgaaaaaguagacgaccucagagcggacacgauaagcucccaaauagagcucgccguacuccucuccaacgagggcauaaucaauagcgaagacgaacaccuucucgcccucgaacgcaagcucaagaaaaugcucggccccucugccguagagaucggcaacggcugcuuugaaaccaaacacaaaugcaaccaaaccugccuagaccgcauagcggcaggcaccuucgacgccggcgaguucucgcuccccaccuucgacagccuaaacaucaccgcagcaucccuaaacgacgacgggcuagacaaccacaccauccuucuguacuacagcaccgccgcaucaucccucgcgguaacacucaugaucgccaucuucguagucuacaugguaucccgggauaacguuaguugcagcaucugccuuuag

SEQ ID NO: 215841 - RNA, 1758 nt, Artificial Sequence
  derived and/or modified sequence opt from Influenza B hemagglutinin
augaaagccaucaucguccuacuuaugguagucaccuccaacgccgaccggaucugcaccggcaucacuuccucgaacagcccccacgucguaaaaaccgccacccaaggagaaguaaacguaacaggcguaauccccuugaccacgaccccaaccaaaucccacuucgcaaaucucaaaggaacugaaaccagaggcaaacuaugcccaaaaugccucaacugcaccgaccuagacgucgcccucggaagacccaaaugcacagggaagauacccuccgcccgcgucucgauauuacacgaaguccgccccguaaccuccggaugcuuccccaucaugcacgaccgcacaaaaauacgacaacucccuaaccuccugagaggcuacgaacauauccggcucuccacccacaacgucaucaacgccgaaaacgcacccggcggcccauacaaaauaggaacaucaggaucaugccccaacaucaccaacggcaacggcuucuucgccacgauggcaugggccguccccaaaaacgacaaaaacaaaacagccacaaacccccucaccaucgaaguaccauacaucugcaccgaaggcgaagaccaaauaacaguauggggauuccacagcgacgacgaaacccagauggcgaaacuauacggcgacuccaaaccccagaaauucacauccucggccaacggagugaccacccacuacgucucacaaaucggcggguucccaaaccaaacagaagacgggggcuugccacaaaguggcagaauaguagucgacuacaugguccaaaaauccggcaaaaccggaacaauaaccuaucaacgaggcauccuccucccgcaaaaaguauggugcgccagcggacgcuccaaagugauaaaaggcucacucccccucaucggagaggccgacugccuccacgaaaaauacggcggacucaauaaaucaaaacccuacuacacgggcgaacacgccaaagcaaucggcaacugccccauaugggucaaaaccccgcuaaaacuagcgaacggcaccaaauacaggcccccagcaaaacuccugaaagaacgcggauucuucggcgcaaucgccggguuccuagagggcgggugggaaggcaugaucgcaggcuggcacggcuacacgucccacggagcacacggcgucgcaguagccgccgacuuaaaaaguacucaagaagccauaaacaaaaucaccaaaaaccucaacuccuuauccgagcucgaagucaaaaaccuccaacgccucucaggagccauggacgaacuacacaacgaaauacucgaacucgacgaaaaagucgaugacuuacgcgcagacacaauauccagucaaaucgaacucgccguccuccucuccaacgaaggcaucauaaacagcgaagacgagcaccuccucgcacuugaacgaaagcuaaagaaaaugcuuggccccucggccguagaaauuggcaacggcugcuuugagacaaaacacaaaugcaaccaaaccugccuggaccgaauagcggcaggaaccuucgacgccggcgaguucagccuucccacauucgacucccucaacauaaccgccgcaagccucaacgacgacggccucgacaaccacaccauccuucucuacuacagcacugcagcguccucccuagccguaacacuaaugauagccauauucguagucuacauggucucacgcgacaacguaagcugcuccaucugccuuuga

SEQ ID NO: 215842 - RNA, 1755 nt, Artificial Sequence
  derived and/or modified sequence opt from Influenza B hemagglutinin
augaaagccauaaucguccuccuaaugguaguaacgagcaacgcagaccgcaucugcacagguaucacauccagcaacagcccacacguagucaaaaccgcuacccaaggcgaagucaacgucacgggcguaauaccacucacgacuacgcccacgaaaucauacuucgccaaccuaaaaggaacacguacgcgaggaaaacuaugcccggacugccucaacugcaccgaccuagacguagcccuaggacgccccaugugcguaggcaccaccccaagugcaaaagccagcauccuccacgaaguccgcccaguuaccuccggcugcuucccaaucaugcacgaccgaaccaaaauccgacaacuucccaaucuccuucgcggcuacgagaaaauacgucucagcacacaaaacgucauagacgcagaaaaggccccaggcggccccuaccgacucggcacguccggcuccugcccaaacgcaacgagcaaaaucggauucuucgcaacaauggccugggcaguccccaaagacaacuacaaaaacgccacaaacccccucacgguugagguccccuacauaugcaccgaaggagaagaccaaauaaccguauggggauuccacagcgacaacaagacccaaaugaaaucccuauacggugacucaaacccacagaaauucacauccucggcaaacggcguaaccacccacuacguuucccaaauuggcgacuucccggaccaaaccgaagacggcggacucccucaaagcgggcgcauagucguugauuacaugaugcaaaaaccaggcaaaacaggcaccaucgucuaccaacgcgguguuuuacucccacaaaaagucuggugcgcauccggacgcucgaaagugaucaaaggaucacucccacucaucggcgaggcagacugccuacacgaggaauacggaggacuaaacaaauccaaaccauacuauaccggaaaacaugccaaggcaaucggcaacugccccauaugggucaaaaccccacucaaacuagcgaacggaacuaaauaccgacccccagccaagcuccuaaaagagcguggauucuuuggagcaaucgcaggcuuccucgaaggcggaugggaaggcaugaucgcggguuggcacggauacacaucacacggagcacacggagucgccguagcggccgaccuaaagagcacacaagaagccauaaauaaaaucaccaaaaaccucaauucccuaucagaacucgagguuaaaaaccuacaacgccucucgggagcgauggacgaacugcacaacgaaauacucgaacuggacgaaaaagucgacgaccugagagcugacacaaucucaagccaaaucgaacuugcaguccuacuguccaacgaaggcaucauaaacagcgaggacgagcaccuacucgcccucgaacgaaaacuaaagaaaaugcuaggacccucagcaguagacaucgguaacggcugcuucgaaacaaaacauaaaugcaaccaaacaugccuggaccguauagccgccggaaccuucaaugccggcgaauuuucccuccccaccuucgacucacucaacaucacagccgccagccuaaacgacgacggguuagacaaccacaccauacuacuauacuacagcaccgcagcauccucucucgcaguaacacucaugcucgcgauuuucauagucuacauggucucccgcgacaacguaagcugcucaauaugccuuuaa

SEQ ID NO: 215843 - RNA, 1755 nt, Artificial Sequence
  derived and/or modified sequence opt from Influenza B hemagglutinin
augaaagcaauaauagugcuccucaugguaguaaccuccaacgccgaccgcaucugcacgggcauaacaucgagcaacagcccgcacguggucaaaacugcaacacaaggcgaagucaacgucacaggugucaucccgcuaacgacaacgccaaccaaaucuuacuucgccaaccuuaaaggcacccgcacacgcggaaaacucugcccggacugccucaacugcacagaccuagacgucgcacucgguagaccaaugugcguaggcacgacccccuccgcaaaagccagcauacuccacgaagugcgcccagucaccagcgggugcuuucccauaaugcacgacagaacaaagauccgacaacugcccaaucuccuacgcggauacgagaaaauccgccuauccacacaaaacgucauagacgcagaaaaagcgccgggcgggcccuaccgacugggcacguccgggagcugccccaacgccacgagcaaaaucggcuuuuucgcaacuauggccugggcaguccccaaggauaacuauaaaaaugcaacgaacccccuaaccgucgaaguccccuacaucuguaccgaaggagaagaccaaauaaccgucuggggguuccacuccgacgacaaaacacaaaugaaaagccuauacggagacuccaacccccaaaaguucacguccucagccaacggugugacaacacacuacgucucccaaauaggcgacuucccggaccaaaccgaagacggaggccuaccccaaaguggacgaauagucguagacuacaugaugcagaaacccgggaaaaccggcaccaucguuuaccagcggggaguccugcucccgcaaaaagucuggugcgcaagcgggcgcuccaaaguaauaaaaggcucccucccacuaaucggcgaagcagacugccuacacgaagaauacggaggacucaacaaaucgaaaccguacuacacuggaaaacaugccaaagccauuggaaacugcccuauaugggucaaaacgccucucaaacucgcaaacggaaccaaauacagacccccagcaaaacuucugaaagaacgcggguuuuucggcgccauagcaggauuccuagaaggcggcugggagggcaugauagcgggcuggcacggguacacaagccacggcgcccacggaguagccgucgcagccgaccucaaaagcacccaagaggccaucaacaaaaucacgaaaaaucuaaacagccuaagcgaacucgaagucaaaaaccuacaacgccucuccggcgccauggacgaacugcauaacgaaauacucgaacucgacgaaaaagucgacgaccuacgcgcagacacaauaucaucacaaauagagcuagcaguacugcucucaaacgaaggcauaaucaacagugaggaugaacaucuccuagcacucgagcgcaaacucaagaaaaugcuuggacccucagcagucgauauaggcaacggcugcuucgaaacaaaacacaaaugcaaccaaacgugccuagaccgaaucgcagccggcaccuucaacgccggugaguucucccuccccaccuucgacucccuaaacaucacagcagcaagccuaaacgacgacggacucgacaaccacaccauccuccucuacuacuccacagccgcauccucccucgcagucacccuuaugcuugcaauauuuaucgucuacauggucucucgcgacaacguguccugcagcauaugucucuga

SEQ ID NO: 215844 - RNA, 1755 nt, Artificial Sequence
  derived and/or modified sequence opt from Influenza B hemagglutinin
augaaagccaucauaguacuacucaugguagucacaaguaacgccgaccgcauaugcaccggcauaaccuccagcaacagcccucaugucgucaaaacagcaacccaaggcgaagucaacguaacaggaguaaucccccuaaccacaacccccaccaaaucguacuucgccaaccuaaaaggcacacgcacccgcggcaagcuaugccccgacugccucaacugcaccgaccuagacgucgcucucggccgccccaugugcgucggaacaacaccgagcgccaaagccuccauccuccacgaaguccgaccgguaaccagcggcugcuuccccaucaugcacgacaggaccaaaauccgccaacuacccaaccuccuacgcggauacgagaaaauacgccucuccacacaaaaugucauagacgccgaaaaggccccaggcggaccauaccgccucggcaccuccggcuccugccccaacgccaccagcaaaaucggauucuucgccaccauggccugggcaguccccaaagacaacuacaaaaaugcgaccaacccccucacagucgaaguccccuacauaugcaccgaaggggaagaccaaaucacaguauggggguuccacagcgacgacaaaacccaaaugaagucccuauacggagacuccaacccccaaaaauucaccagcucagccaacgguguaaccacccacuacguaucacaaauaggcgacuucccagaccaaacggaagacgagggacucccccaauccggccgcaucguaguagacuacaugaugcaaaaacccggcaaaacaggcacaaucgucuaccagcgcggcguccuucucccccaaaaaguauggugcgccagcggccgcuccaaaguaaucaaaggcuccuugccgcucaucggcgaagcagacugccugcacgaagaauacgguggccucaacaaaucuaaaccauacuacacaggcaaacacgccaaagccaucggcaacugccccaucuggguaaagacaccacucaagcucgccaacggcacaaaauaccgacccccugccaaacucuugaaagaacgcggcuucuuuggcgcaaucgcgggcuuccucgagggcggaugggaaggcaugaucgcuggcuggcacggcuacaccucccauggcgcacacgggguagcggucgcagcugaccuaaaaucaacccaagaagccauuaacaaaaucaccaaaaaccucaacucacucagcgagcuagaggucaagaaccuacaacgccucagcggcgccauggacgaacugcacaacgaaauacucgaacucgacgaaaaagucgacgacuuacgggccgacacaaucuccucccaaaucgagcucgccguacuccucuccaaugaaggcaucauuaacagugaagaugaacaccucuuagcgcucgaaagaaaacucaagaaaaugcucggacccagcgcagucgacauaggcaacggcugcuucgaaacaaaacacaaaugcaaccaaacaugucuggaccggauagccgccggcacauucaacgcaggcgaguucucucuaccgaccuucgacucacucaacaucacagccgcaucacucaacgacgacggacuagacaaccacacaauacuacuuuacuacucaacagccgcaagcucccucgcaguaacgcucaugcuagcaaucuucaucguauacauggucucacgugacaacguaucauguucaauaugccuauaa

SEQ ID NO: 215845 - RNA, 1755 nt, Artificial Sequence
  derived and/or modified sequence opt from Influenza B hemagglutinin
augaaagccaucaucguacuacuaauggucgucaugagcaacgccgaccgcauuuguaccggcauaacaucuagcaacagcccacacgucgucaagaccgcgacacaaggcgaagucaauguaacaggcgucaucccacucacaaccaccccaaccaaauccuacuucgcaaaccucaaaggcacgcgaacacgcggaaaacugugcccagacugccucaacugcacagaccuggacguggcacuaggcaggcccaugugcgucgguacuacccccagcgcgaaggcaaguauacuucacgaaguacggccagucacaucuggcugcuuccccauaaugcacgacagaacgaagauacgacaacuacccaaccuccuacgcggauacgagaaaauacgccuauccacccaaaacgucauagacgcagaaaaagcccccggcggccccuaccgccuaggcacgagcggaagcugccccaaugccacauccaaaaucggguucuucgccacgauggcgugggcgguaccaaaagacaacuacaaaaacgccacgaacccccaaacagucgaagucccauacauaugcacagaaggagaagaccaaauaacaguauggggguuccacagcgacaacaaaacccaaaugaaaagucucuacggggacuccaacccacaaaaguucacaagcagcgccaacggcguaaccacacacuacgucucgcaaauaggcgacuuccccgaccagaccgaagacggcggucuaccccagagcggacgcaucgucgucgacuacaugguacaaaaacccgguaaaacaggcacaaucguauaccagcgcggaguacuacucccacaaaaagucuggugcguaagcggucgcucaaaagucaucaaaggcucacucccgcuaauaggcgaagcagacugccuacacgaagaauacggcgggcuaaacaaaucgaaaccguacuacaccgggaaacacgcaaaagccauuggaaacugcccaaucugggucaaaacaccacuuaagcucgccaacggaaccaaauacagacccccagccaagcuccugaaagagcgaggguucuucggcgcuauagcaggcuuccuagaaggcggaugggaaggaaugauugcgggcuggcacggauacacaucccacggagcgcacggcguagccgucgcagccgaccuuaaaucaacgcaagaggcaaucaacaaaaucaccaaaaaccucaacagcuuaucagaacucgaagucaaaaaccuccaacgccucuccggcgcaauggacgaacuacacaacgaaauccuagaacucgacgaaaagguagacgaccuacgcgcagacacgaucagcucccaaauagagcucgcaguauuacuguccaacgaaggcauaauuaacagcgaagacgagcaucugcucgcacuagaacgcaaacucaagaaaaugcucggccccuccgccgucgacaucggcaacggcugcuucgagaccaaacacaaaugcaaccaaacaugccucgacaggaucgcagcagggacauucaacgcgggcgaguucucccuuccaacauucgacucacucaacaucaccgcggcaagccuuaacgacgauggacucgacaaccacaccauacuccucuacuacagcacagccgcgagcucacuggcaguaacucucaugcucgcaauauucauagucuacauggucucgagagacaacguaagcuguagcauaugccucuga

SEQ ID NO: 215846 - RNA, 1758 nt, Artificial Sequence
  derived and/or modified sequence opt from Influenza B hemagglutinin
augaaagccaucaucguacuacuaauggucgucaccuccaacgcggauagaaucugcacaggcaucacauccucaaacucaccccacguaguaaaaacagcaacgcaaggagaagugaacgucacuggcgucauaccacucacaacaacacccaccaagucccacuucgcaaaccuaaaagggacagagaccagaggcaaacucugccccaagugucugaacuguaccgaccucgacgucgcccucggcagaccaaagugcaccggaaaaauaccaucggcccgugugucaauccuacacgaaguacggcccgucaccucaggguguuucccgaucaugcacgaucgcaccaaaauccgccaacucccgaaccugcuccguggcuaugaacacauccggcucucaaccaacaacgugaucaacgccgaaaacgcccccggcggaccauacaaaaucggcaccucgggaucuugcccaaacguaaccaacggaaacggcuucuucgcgaccauggccugggccguccccaaaaacgacaaaaacaaaacagccacgaacccacucacaaucgagguccccuacauaugcacagaaggugaagaucaaauuacaguguggggcuuccacagcgacaacgagauccagauggccaaacuauacggugacucucgcccucaaaaguucacaagcucggccaacggcguaaccacacacuacguuucccaaauaggcggcuucccaaaccaaacugaggacgggggauuaccacaaagcgggaggaucgucgucgacuacaugguccagaaaagcggaaaaacaggcaccaucacauaccaacgagggauccugcucccacaaaaaguauggugcgcgagcgggcgaucaaaagucauaaaaggaucgcuaccacuuauaggcgaagcagacugccuacacgaaaaauauggcggacucaacaaaucgaaaccauacuacaccggagaacacgccaaggcaaucggcaacugccccaucugggucaaaaccccgcucaaacucgcaaacggaaccaaauacagaccacccgcaaaacuacugaaagaacgcggguucuucggcgcgaucgcuggcuuccucgagggcgggugggagggaaugaucgcaggcuggcacggauacacaagccacggcgcacacgguguagcagucgcggccgaccucaagagcacacaagaagccauaaacaaaauaacgaaaaaccucaacagccuaagcgagcucgaagucaaaaaccugcaacgacucagcggcgccauggaugaacuccacaacgaaauacucgagcucgacgaaaaaguagacgaccuccgcgcagacacaaucuccagccaaaucgagcuagcuguccuucucucgaacgaaggcaucaucaacagcgaagacgaacaccuacucgcgcuagaacgcaaacucaagaaaaugcucggccccucggcagucgagauaggcaacggaugcuucgagacaaaacacaaaugcaaccaaaccugccuagaccgaaucgccgccggcaccuucgaugcaggcgaguucucccuccccaccuucgacagccuaaacaucacagcagcaagucuaaacgacgacggccucgauaaccacacaauacuacuauacuauagcacggcugcgucaucacuagcagucacacucaugaucgcaaucuucgucguauacauggucuccagagacaacgugucaugcaguaucugccuauaa

SEQ ID NO: 215847 - RNA, 1758 nt, Artificial Sequence
  derived and/or modified sequence opt from Influenza B hemagglutinin
augaaagcaaucauagucauacuaauggucgugacaucaaacgcagaccguaucuguaccggcauaacaagcucgaacucgccccaugucguaaaaacagccacccaaggagaaguaaacgugaccggaguaauaccccugaccaccaccccaacaaaaagccacuucgcgaaccuaaaagggaccgaaacacggggcaaacuaugcccaaagugcuugaacugcaccgaccuagaugucgcgcuaggacgaccgaaaugcaccggcaaaauaccuucagcacgggucagcauacugcacgaagucagacccguaacuucaggcuguuucccaauaaugcacgaccgcacgaaaauacgccaacuccccaaccuacuuaggggcuacgaacacaucagacuaagcacccacaacgucaucaacgccgaaaacgccccaggaggcccuuacaaaaucggaaccuccggcucaugccccaacauaaccaauggcaacggcuucuucgcgaccauggcaugggccguacccaagaaugauaaaaacaaaacggccacgaacccucuaaccauagaaguccccuacauaugcacagaaggggaagaucagaucacaguauggggcuuccacagcgacagcgaaacccaaauggccaaacucuacggggacucgaaaccacaaaaauucacgaguuccgcaaacggcguaaccacgcacuacgucucacaaaucggaggauucccaaaccagacagaagacggaggacuaccgcaaucaggccgcaucgucguagacuacaugguacagaaaagcggaaaaacaggcacaaucacauaucaacgaggaauccuacucccgcaaaaaguauggugcgcaagcgggcgcucaaaagugaucaaaggcucccucccacucaucggagaagcugacugccuacacgagaaauauggcggccucaacaaaucaaaaccauacuacaccggagaacacgcaaaggccauaggaaacuguccgaucuggguaaaaaccccgcucaaacucgcgaacggcacaaaauauagaccacccgccaaacucuugaaagagcgcggauucuucggcgcaauagcgggauuucuagaaggcggcugggaaggcaugauagcgggcuggcacggguacacgagccauggcgcccacgggguagcagucgcggccgaccucaaauccacgcaagaggccaucaacaaaauaaccaagaaccucaacagccuaagugaacuugaggucaaaaaccuacaaaggcucucgggcgcgauggacgaacuccacaacgaaauacucgaacuagacgaaaaaguagacgaccugcgagcggacacaaucucaagccaaaucgaacucgcaguccugcuaucaaacgagggaauaaucaauagcgaagaugagcaccuacuagcacucgagcgcaaacuaaagaaaaugcucggacccuccgccguugaaauaggcaaugggugcuucgaaaccaaacacaaaugcaaccaaacaugccuagacagaaucgcggccgggaccuucgacgcgggcgaguucucacucccgacauucgacucgcuaaauaucacggccgcgagucugaacgaugacgggcucgacaaccacaccauccuccuguacuacuccacggccgccagcucgcucgccgucacgcuuaugauagcaauauucguaguauacauggucucgagagacaacguauccugcagcauuugccuguaa

SEQ ID NO: 215848 - RNA, 1758 nt, Artificial Sequence
  derived and/or modified sequence opt from Influenza B hemagglutinin
augaaagccaucaucguccuccuaauggucgucacauccaacgcggaccgaaucugcacuggcaucacguccucuaacucaccccauguagucaaaaccgccacccaaggcgaagucaacgugaccggggucaucccccugaccacuaccccaaccaaaucgcacuucgcgaaccugaaaggcaccgaaacacgcggaaaacuaugccccaaaugccucaacuguaccgaccucgacgucgcccuaggccggccaaaaugcaccggaaaaauaccaucagcaagaguaucaauccuacacgaaguacgccccgucacauccggcugcuucccaaucaugcacgaccgaacaaaaauccgacagcucccaaaccuccuccguggcuacgaacacauacgccuaucaacccacaacgucaucaacgccgagaacgcaccugguggaccauacaaaaucggcacuucaggcucaugucccaauauaaccaacggaaacggcuucuucgccaccauggcaugggccguccccaaaaacgacaaaaacaaaacagccacaaacccccuaacaauagagguaccauacaucugcacagagggggaagaccaaauaaccguauggggauuccacucagacagcgagacucagauggcaaaacucuauggagacucaaaaccccaaaaauucacgagcucggcaaacggugucacaacacacuacgucucacaaauaggcggcuucccaaaccaaaccgaggacggcggccugccacaauccgggcgcaucgucgucgacuacauggugcagaaaagcggcaaaacaggcacaaucacauaccaacgcggaauacuccuaccacaaaaagucuggugcgcuagcggccgcucaaaaguaaucaaaggaucgcucccacucauaggagaagccgauugccuacacgaaaaauacggcgggcucaacaaauccaaaccguacuacaccggggaacaugccaaagccauaggaaacugcccaauaugggucaaaacaccccucaaacuagccaacggaaccaaauacaggcccccugccaaacuccuaaaagagcgaggauucuucggcgcaaucgcuggauuccucgagggcgggugggaaggcaugaucgccggcuggcacggcuacaccucccacggagcccacggggucgcugucgccgccgaccucaaauccacccaagaagccaucaacaaaaucaccaaaaaccucaacagccuauccgagcucgaagucaagaaucuccaacggcucucaggcgcaauggacgaacuacacaacgaaauacucgaacucgacgaaaaggucgaugaccuaagagcggacacuaucuccucccaaauagaacucgcaguccuacucuccaacgaaggcauaaucaauagcgaagacgaacaccuucuagcccuugaacgcaaacucaagaaaaugcucggacccucagcaguagaaauaggcaacggcugcuucgaaaccaaacacaaaugcaaccaaacgugccucgaccgaaucgccgccggaaccuucgaugcgggagaguucucucucccaacauucgacucacucaacaucaccgccgccucccucaacgacgacggccucgacaaucacaccauucuucuauacuacagcacggccgcaagcucacucgcaguaacacuaaugauagcaauauucgucguauacauggucucccgugacaacgucuccugcagcauaugccuguga

SEQ ID NO: 215849 - RNA, 1758 nt, Artificial Sequence
  derived and/or modified sequence opt from Influenza B hemagglutinin
augaaagcaauaauaguccuacucauggucguaaccuccaacgcagacagaaucugcaccggaaucacgaguucaaacagcccccacguagucaaaacggcaacccaaggcgaagugaacguuaccggcgucauaccccucaccacaaccccgaccaaaucccacuucgccaacuugaaagggaccgaaacccggggaaaacucugccccaaaugccugaacuguacagaccucgauguagcccucggacgcccgaaaugcaccggcaaaauucccucagcacgggucucaauccuacacgaaguccgccccgucaccuccggcugcuucccgaucaugcacgaccgcaccaagauucgacaacuacccaaccuccuccgcggcuacgaacacguccgacucucaacccacaacgugaucaacgcugaagacgcacccggaggaccauacaaaauaggcacaagcggcucaugccccaacauaacuaacgguaacggcuucuucgcgaccauggcaugggccguacccaagaacgacaaaaacaaaacagcaaccaacccccuaaccaucgaagucccauacaucugcacagaaggagaagaccaaaucaccgucuggggauuccacagugacaacgaaacccaaauggcaaaacucuacggcgacuccaaaccacaaaaauucaccuccuccgcaaacggcguaaccacucacuacgucucacaaaucggcggcuuccccaaccaaaccgaagacggcggacuaccccagagcggacgcaucgucguggacuacaugguccaaaaauccggcaaaacaggcacgaucaccuaccaacgcgguauccuccucccgcaaaaagucuggugcgcauccggccgcuccaaaguaaucaagggcucgcuuccacucaucggcgaagccgacugucuacacgaaaaauacgggggacucaacaaauccaaaccauacuacaccggagaacacgccaaggcuaucggcaacugcccgaucuggguaaaaacuccacucaaacuagccaacggaaccaaauaccgcccaccagccaaacuauuaaaggaacgcggauucuucggagccauagcugguuuccuagaaggcggcugggagggcaugaucgccggauggcacggcuacaccagccacggcgcacacggcgucgcagucgccgccgaccuaaaaagcacucaggaggcuaucaacaagaucaccaaaaacuuaaacagccuaagcgaacucgaagucaaaaaccuacaacgccucucgggcgccauggacgaacuacauaacgaaauucucgaacuugaugaaaaaguagacgaccuucgcgcagacacaaucucaucccaaaucgagcucgcaguccuacucucaaacgagggaaucauuaauagugaagacgaacaccuacucgcccuagagcgcaaacucaagaaaaugcucggucccuccgccguggaaaucggaaacggaugcuucgaaacaaaacacaaaugcaaccaaaccugccuggaccgaaucgccgccggcacuuucgacgcaggcgaguucucacugccgacguucgacucccucaacaucacugccgcgucccucaacgacgacgggcuagacaaccacaccauccuccuuuacuacagcaccgcagccaguucccuagcagucacccucaugaucgcaaucuucgucgucuauauggucucacgagacaaugucuccugcagcaucugccuauaa

SEQ ID NO: 215850 - RNA, 1758 nt, Artificial Sequence
  derived and/or modified sequence opt from Influenza B hemagglutinin
augaaagccaucaucguccuacuaaugguugucaccucuaaugcagaucgcaucugcaccggcaucaccucauccaacucaccacacguagucaaaaccgccacccaaggagaaguaaacgugacaggcgucaucccacugaccacaacccccaccaaaagccacuucgccaaccugaagggaaccgagacucgaggaaaacucugccccaaaugccucaacugcaccgaccuagacguagcccuuggccgccccaaaugcacuggcaaaauacccuccgcucgcgucucaauccuacacgaaguccgccccgucaccucaggcugcuuccccaucaugcacgaccgcaccaaaauacgccaacuccccaacuuacuccgaggcuacgaacacgucagacuaucaacccauaacgucaucaacgccgaagacgcccccggcggcccuuacaaaaucggcaccucaggcucaugccccaacaucaccaacggcaauggauuuuucgcaaccauggccugggccguacccaagaacgacaaaaacaaaacugccaccaacccccucacaaucgaggucccuuacaucugcaccgaaggagaggaccaaaucacaguuugggguuuccacuccgacgacgagacccaaauggcgaaacucuacggugacucaaaaccccaaaaguucaccuccucagccaacggcguaacaacccacuacguaucacaaaucggcggcuuccccaaccaaacagaagacggcggccuaccacagaguggccgaaucgucguggacuacaugguacagaaaaguggaaaaacgggcacaauuacguaccaacgcggaauccuucuaccgcaaaaggucuggugcgccuccgggcgguccaaagucaucaagggcucccuaccacucaucggagaagccgauugcuuacacgagaaauacggcggacuaaacaagagcaaaccauacuacacaggagaacacgccaaggccaucggaaacugccccauaugggucaaaaccccacucaaacucgcaaacggaacgaaauaccgaccucccgcaaagcuccuuaaagaacgaggguucuucggagcaaucgccggcuuccuagaaggcggaugggaaggcaugaucgcagguuggcacggauacaccagccauggagcccacgggguagcuguagccgcagaccucaagucaacccaagaagcaaucaacaaaauaacgaaaaaccuaaacagccucuccgaacucgaagucaaaaaccuacaacgacuguccggagccauggacgaacuacacaacgaaauccucgagcuagacgaaaaaguagacgaccuacgcgcagacacaauauccagccaaaucgaacucgccguucugcucuccaacgaaggcaucaucaacucugaagacgaacaccuacucgcacuagaacgaaagcugaagaaaaugcuaggccccuccgccgucgaaauaggaaacggcuguuucgaaaccaaacacaaaugcaaccaaacgugccuggaccgaaucgccgccggcacauucgacgcaggagaauuuucccuccccaccuuugacucacuaaacaucacugccgccagccuaaacgacgacggacucgacaaccauaccauacuccucuacuacagcacugcagcaucaucacuagcagucacccuaaugaucgcaaucuucgucgucuacaugguaucaagagacaacguguccugcucaaucugucuauaa

SEQ ID NO: 215851 - RNA, 1755 nt, Artificial Sequence
  derived and/or modified sequence opt from Influenza B hemagglutinin
augaaagcaauaaucguccuccuaaugguagucacaagcaacgccgaccguauaugcaccggcauaacauccuccaacucaccccacgucgucaaaaccgcuacccaaggcgaaguaaacgucaccggaguaauaccgcuaacgaccaccccaaccaaauccuacuucgcaaaucuaaaaggcacacgcacacguggcaagcugugccccgacugccucaacugcacggaccuagacguagcccucggacggcccauguguguugggacgacaccaucagccaaagccagcauacuucacgaggugcgcccggucacgagcgggugcuuccccaucaugcacgacagaaccaaaaucagacaacugcccaaccuccuacgaggauacgaaaagauacgccuuagcacacaaaacguaauagacgcggagaaagccccgggcgggccauaccguuuaggcaccagcggaagcugccccaacgcaacaagcaaaaucggauucuucgccaccauggcaugggcaguaccaaaagacaacuacaaaaacgcuacaaacccacuaacaguagaaguccccuacauuugcacagaaggagaagaccaaauuaccgucuggggauuccacuccgacaacaagacccagaugaaaucacuauacggugacagcaacccccaaaaauucacgagcucggccaacggcguaacaacccacuacgucucacaaaucggcgacuucccagaccaaaccgaggacggcggccuaccacagagcgggcgaauagucguggacuacaugaugcaaaaaccaggaaaaacaggaacaaucgucuaccagcgcgggguccuacucccacaaaaggucuggugcgcauccggacgcucaaaaguaaucaaaggcucacucccacucaucggcgaggccgacugccugcacgaagaauacggcggccuaaacaaaucaaaacccuacuacacaggaaaacacgccaaagcaauaggaaacugcccgauauggguaaaaacaccacucaagcucgcaaacgggaccaaauacagaccaccagccaaacuucuaaaagaacgcggguucuuuggcgcgaucgcaggcuuccucgagggcggcugggaaggcaugaucgccgguuggcacggauacacaucacacggugcgcacggggucgcagucgcggccgaccuuaagagcacgcaagaagccauaaacaaaaucaccaaaaaccucaacagccuuagcgagcucgaagucaaaaaccuccaaaggcuuucgggagcgauggacgaacugcacaacgaaauccucgaacucgacgaaaaaguagacgacuugcgcgccgacacaauuuccagccaaaucgagcuagccguacuacucagcaacgaaggcauaaucaauagcgaagacgaacaucugcuugcacucgaacgaaaacucaagaaaaugcuuggccccuccgccgucgacauaggaaacggcuguuucgaaacaaaacacaaaugcaaccaaacaugccuagaccggaucgcagcaggaacauuuaacgccggcgaguucucacucccgacauucgacucccuaaauaucacggccgcaagccuaaacgaugauggacucgacaaccacacaauccucuuguacuacagcaccgccgcuagcucccuggcgguaacacucaugcucgcuaucuuuaucgucuacauggucucacgagacaacgugucaugcuccaucugccuauga

SEQ ID NO: 215852 - RNA, 1755 nt, Artificial Sequence
  derived and/or modified sequence opt from Influenza B hemagglutinin
augaaagccauaaucguccuucucaugguagucacaagcaaugccgaccgcaucugcacgggaaucaccucauccaacucaccccacgucgucaagacagcaacucagggcgaaguaaacgucaccggaguuaucccacucaccaccacccccacaaaaucauauuuugccaaccuuaagggcacccgcacccgcgggaaacucugccccgacugccucaacugcacggaccuagauguagcucucggacgccccaugugcgucggcaccacccccuccgccaaggccuccauucuccacgaaguccguccaguaaccagcggcugcuucccuaucaugcacgaccgcacaaaaaucaggcagcuacccaaccuuuuacgcggauacgagaaaauccgccuaagcacccaaaacgucaucgacgcagaaaaagccccgggcggccccuaccgccucggcaccuccggcuccugccccaaugccacaucaaaaaucggguucuucgcuaccauggcuugggccguacccaaagacaauuacaaaaacgccacaaacccgcucaccgucgaaguccccuacauaugcaccgaaggggaagaccaaaucaccgucuggggcuuucacagcgacgauaaaacccaaaugaaaagccucuauggcgacuccaacccacaaaaguuuacuuccucagcaaacggcgucaccacccacuacguaucacaaauaggcgacuuccccgaucaaaccgaagacgggggucucccccaauccggccgaauuguaguagacuauaugaugcaaaaacccggcaaaaccggcacaaucgucuaccaacgaggcguccuccuaccccaaaaagucuggugcgcguccggccgauccaaaguaauaaaaggaucacucccgcuaaucggcgaagccgacugccuacacgaagaauacggcgggcuaaacaaauccaaaccauacuacacuggcaaacacgcaaaagcaaucggaaacugccccauaugggucaagacuccgcucaagcucgcaaacggcaccaaauaccgacccccagccaaacuccucaaagaacgcggguucuucggcgcgaucgccggauuccuagaaggcggcugggagggcaugauagcaggcuggcacggauacaccucccacggcgcacacggcgucgcaguugccgccgaccucaaaagcacccaagaagccauaaacaagaucacgaaaaaccugaacagccucucagaacucgaaguaaagaaccuacaacgccucucuggagcaauggacgaacuacacaacgaaauucucgaacucgacgaaaaagucgacgaccuccgugcagacacaaucuccucucaaaucgagcuugccguccuccucuccaacgaaggaauaaucaacucagaagacgaacaccuccucgcacucgaacgcaagcucaagaaaaugcuuggaccaucagccgucgacauaggaaacggcugcuucgaaaccaaacacaaaugcaaccaaacuugccuggaccguauagcggcaggcaccuuuaaugcaggagaguucucccuccccaccuucgacucacucaacauaaccgccgcaagccucaacgacgacggacucgacaaccacaccauccuccucuacuauagcacagcagcuucaucacuugccgucacccuuaugcucgccaucuucauuguauacauggucucccgcgacaacguaagcuguucaauaugccucuga

SEQ ID NO: 215853 - RNA, 1755 nt, Artificial Sequence
  derived and/or modified sequence opt from Influenza B hemagglutinin
augaaagccauaaucguccuccucaugguaguaacgagcaaugcugaccgcauaugcacaggaaucacuuccucaaauagcccacacguagucaaaacagcaacccaaggcgaaguaaacgucaccggcguaaucccacucacgaccacacccacaaaaucauacuucgccaaccucaaaggcacacgcacgcgcggaaaacucugcccagacugccuaaacugcacggaccuggacguagcccugggccgccccaugugcguaggcaccaccccaagugcaaaagcauccauacuacacgaaguccgcccaguaacgagugguugcuucccaauaaugcacgaccgaacaaagauacggcaacucccaaaccuccuucgcggauacgaaaagauacgccugucaacacaaaacguaauagaugcagaaaaggcaccgggcggcccauaccggcuaggaaccagcggguccugccccaaugcaaccagcaaaaucggcuucuucgcaaccauggccugggcaguccccaaagacaacuacaaaaaugcaacaaacccauuaaccgucgaagucccauacauaugcacagaaggagaagaccaaauaaccgucuggggauuccacagcgacaacaaaaaccagaugaaaucuuuauacggcgacagcaacccacaaaaguucacuagcucagcaaacggcguaaccacacacuacgucucccaaauaggcgacuucccagaccagaccgaggacggaggccuaccccaaagcgggcgcauagucgucgacuacaugaugcaaaaacccggcaaaaccggcacaaucgucuaccaacgcggaguacucuuaccacaaaaggucuggugcgcaagcggacgcucgaaaguaauuaaaggaucucuaccacucauaggagaggccgacugccugcacgaagaauacggcggacucaacaaaucaaaacccuauuacaccggcaaacacgccaaagccaucggcaacuguccaaucugggucaagaccccacucaaacucgccaacggcaccaaauaccgucccccggcaaagcuccuaaaagaacgcggauucuucggagcgaucgccggcuuccucgagggcggaugggagggcaugauagcaggcuggcacggauacaccagccacggcgcccacggaguagccgucgcagcagaccucaaaucaacacaagaggcaauaaacaagauaacgaaaaaccucaauagucugucagagcucgaaguaaagaaccuccaacgccucuccggagcgauggacgaacuccacaacgaaauccuagaacucgacgaaaagguagacgaccuacgagccgacaccauauccucccagaucgagcucgcgguucuccucucgaacgaaggcaucaucaacagcgaggacgaacaccuacuagcucuugaacgaaaacucaagaaaaugcucggcccgucagcagucgacaucgguaacggcugcuucgagaccaaacacaaaugcaaccagacaugccucgaccgcaucgccgccggcacguuuaacgcaggagaguucucccucccaacauucgauucgcucaacaucacagccgcaagccucaacgacgacggccuugacaaccacacaauucuccuuuacuacucaacggccgcauccucgcucgccgucacacuuaugcucgcaaucuucaucgucuacaugguaucccgugacaacgugagcugcucaauaugccuauaa

SEQ ID NO: 215854 - RNA, 1755 nt, Artificial Sequence
  derived and/or modified sequence opt from Influenza B hemagglutinin
augaaagccaucauaguacuacuaaugguaguaaccagcaacgccgaccgcaucugcaccggaauaaccuccaguaacaguccccacgucgucaaaaccgccacccaaggagaagucaacgucaccggcguaaucccccucacgaccacacccacaaaaucuuacuucgccaaccucaaaggcaccagaacccgagggaaacucugcccggacugccucaacugcacagauuuagacguggcacuaggacgcccaaugugcgucggcaccacccccucagccaaagccagcauacuccacgaagugcgcccagucacgagcggaugcuuccccauaaugcacgaccgaacaaaaauaaggcaacugcccaaccuacuccgaggauacgagaaaauccgucuuuccacccaaaacguaaucgacgcggaaaaagcccccggaggccccuaccgccuaggcaccuccggcucaugccccaaugccaccuccaaaaucggguucuuugccaccauggccugggccguacccaaagacaacuacaaaaaugccacaaacccacaaacugucgaaguccccuacauaugcaccgaaggagaagaccaaaucaccguauggggcuuccacagcgacaacaaaauucaaaugaaaagccuguacggcgacuccaacccacaaaaauucacaagcucagccaacggcguaacaacacacuacguaucacaaaucggcgacuuccccgaccaaacagaagacgggggacuaccccaguccggacgcaucgucgucgacuacaugguacaaaaacccggaaaaacgggcacuaucgucuaccaacgcggcguauugcucccacagaaaguauggugcgcuuccggacgcuccaaaguaaucaagggcucccucccccuuauuggcgaagccgacugccugcacgaagaauacggcgggcucaacaaaucaaaaccauauuacaccggaaaacacgccaaagcuauaggcaauugcccaaucugggucaaaacaccccucaagcucgccaacggcacaaaauaccgaccacccgccaaauuacucaaagaacgcggauucuucggcgcaauagcaggcuuucucgaaggcggcugggaagguaugauagcaggcuggcacggcuacacaagccacggcgcccacgggguagcagucgcugccgaccucaaaucgacccaagaagccaucaacaaaaucaccaaaaaucuuaacucgcuauccgaacucgaagucaaaaaccuacaacgccuaucgggcgcgauggacgaacuccacaacgaaauccucgaacucgacgaaaaaguagacgaccuacgcgcagacacuaucuccagccaaauagaacuugccguccuacucuccaacgaaggcaucaucaauagcgaggacgagcaccuacuggcccucgaacgaaaacucaagaaaaugcucggacccuccgcgguagacaucggcaauggcugcuucgaaacaaaacacaaaugcaaccaaacaugccucgaccgaaucgccgccggcaccuucaacgccggcgaguucucacuaccaaccuucgacucacuaaacaucacugccgcgucacuaaacgacgacggccucgacaaccacacuauccuccuauacuacucuacagcagcaagcucucuggccgucacacucaugcucgcaaucuucaucguauacauggucucccgcgacaacgucaguugcagcauaugccuguga

SEQ ID NO: 215855 - RNA, 1755 nt, Artificial Sequence
  derived and/or modified sequence opt from Influenza B hemagglutinin
augaaggccaucaucguccuccuaaugguagugaccaguaacgcagaccgaaucugcacagguaucaccucaaguaacagcccccacguaguaaaaaccgccacccaaggugaagucaacgucacgggcgucaucccacuaacaaccacaccaacaaaaucauacuucgccaaucucaagggcacacgcacccgaggaaaacucugcccggacugucucaauugcacagaccucgacguugccuuaggcaggcccaugugcgugggcacgacaccaagcgccaaagcaagcauacuacacgaaguucgcccggucacaagcggcugcuuccccauaaugcacgaccgcacaaagaucaggcaauuacccaaccucuuacgcggcuacgagaaaauccgccucagcacccaaaacgucaucgacgcagaaaaggcccccggcggcccauacagacucggcaccagcgggagcugucccaacgcaaccagcaaaauuggauucuucgccacuauggcaugggccgucccgaaagacaacuauaaaaacgccaccaacccccaaacggucgaagucccauacauuugcacggaaggcgaagaccaaauaacaguauggggcuuccacuccgacaacaaaacucaaaugaaguccuuauacggagacagcaauccacaaaaguucacauccucagccaacggcguaaccacgcacuacgucucacagauaggcgacuuccccgaccaaaccgaagacggaggccuaccccaaagcggucgcauaguagucgacuacauggugcaaaaacccggaaaaacgggcaccauaguguaccaacgcggaguacuccucccgcaaaaagucuggugcgcauccggacgcucaaaaguaauaaaaggcucccucccacucauaggcgaagccgacugccuacacgaggaauacggaggccucaacaaaaguaaaccauacuacacaggcaaacacgccaaggccauaggaaacugccccaucugggucaagacaccccucaaacuagccaacggcaccaaguaccgaccacccgccaaacuccuaaaagaacgcggguucuucggcgccaucgccggcuuccuagagggcggaugggaaggcaugaucgcgggcuggcacggguacaccucucacggcgcccacggagucgcggucgccgccgaccucaaaagcacacaagaagccauaaacaagaucacuaaaaaccuaaacagccuauccgagcuagaggucaaaaaccuacaaagacuauccggcgcaauggacgaacugcacaacgaaauccuagaacucgacgaaaaaguagaugaccugcgagccgacacuaucuccagccagaucgagcucgccguccuacuaucaaacgaaggcaucauaaacucagaagacgaacaccuucuagcccuagaacguaagcucaagaaaaugcucggcccaucagcaguggacaucggcaacggcugcuucgagacaaaacacaaaugcaaccaaaccugccucgaccggauagccgccgguacuuucaacgcaggcgaguucucgcuccccacauucgacucccucaacaucacagccgcuagccucaacgacgacggccucgacaaucacacuauacuccuguacuacagcacagccgccagcucgcuagcaguaacgcucaugcuagccaucuuuaucgucuacauggucucccgcgauaacgugagcugcagcauaugccucuga

SEQ ID NO: 215856 - RNA, 1755 nt, Artificial Sequence
  derived and/or modified sequence opt from Influenza B hemagglutinin
augaaagcaauaauaguacuccugauggucgucacaagcaacgcagacagaaucugcacgggcaucaccucaaguaacagcccacacguagucaaaacagcgacccaaggugaagucaacgucacagggguaauaccacucacaacaacgcccacaaagucguacuuugccaaucucaagggaacgcgcacgcgaggaaaacuaugcccagacugccucaacugcacagaccucgacguagcccugggccggcccaugugcgugggcacgaccccaucagcaaaagccagcauacugcacgaaguaagacccgucacaagcggaugcuuucccauuaugcacgacaggaccaaaauacggcaacuaccaaaccuccuccgaggauacgagaaaauacgccugagcacccaaaacgucauugacgcagaaaaagcaccuggugguccauaccgccuaggaacgagcgaaagcuguccaaacgccacgagcaaaaucggguucuucgccacaauggccugggcaguaccuaaagacaacuacaaaaacgccacuaacccgcaaacagucgagguccccuacaucugcacggaaggagaagaccaaauaaccguauggggauuccacucggauaacaaaauccagaugaagagucuguacggggacuccaacccacaaaaauucacguccucagccaacggagucaccacgcacuacguaucucaaauaggcgacuucccagaucaaaccgaggacggaggccuaccccagagcggucgcaucgucguggacuauaugguacaaaaacccggaaaaacgggcacgaucguguaccaacgaggagucuuacucccacaaaagguauggugcgccagcggacgcuccaaagugaucaaaggaucccucccacucauuggagaggccgauugccugcacgaggaguacggaggccucaacaaaucaaaaccguacuacaccggaaaacacgccaaagccauaggcaacugcccaaucugggucaagaccccgcucaaacucgcaaacggaaccaaauacaggcccccagccaagcuccuaaaagaacgaggauucuucggcgcaaucgcaggcuuccucgaaggcggaugggagggaaugaucgcaggcuggcacggguacacgagccacggcgcacacgggguagcugucgccgccgaucuaaaaaguacgcaagaggccauaaacaaaauaacgaagaaccucaacagccuaagugaacuagaagucaaaaaccugcaacgccucuccggcgccauggacgaauugcacaacgaaauccuagagcuagacgaaaaagucgacgaccuacgagcggacacgauaucgagccaaaucgaacuagcgguccuccucucaaaugagggcauaaucaacagcgaggacgagcaucugcucgcacucgaaagaaagcucaagaaaaugcuagguccauccgcaguggacaucggcaacggcugcuucgaaaccaaacacaaaugcaaccaaaccugccuagaccgaaucgcggccgggaccuuuaacgcaggcgaauuuucgcuccccacauucgacucgcucaacaucacagcugcgagcuuaaaugacgacggacucgacaaucacaccauacuacuguacuacagcacagcagcaagcucacuagccguaacccucaugcuagcgaucuucaucgucuacauggucucacgcgacaacguaaguugcagcauaugucuauaa

SEQ ID NO: 215857 - RNA, 1758 nt, Artificial Sequence
  derived and/or modified sequence opt from Influenza B hemagglutinin
augaaagcaaucaucguccuccuaaugguagucaccagcaacgccgaccgaaucugcacaggaaucacuucuuccaacucaccacacguagucaaaaccgccacacaaggcgaagucaaugucaccggcgucaucccccuuaccaccacaccaaccaaaagccauuucgcaaaccucaaaggaacagagacaagaggcaagcuaugucccaaaugccuaaacugcaccgaccucgacgucgcgcuaggucgccccaaaugcacaggaaaaauccccuccgcccgagucucaauccuccacgaaguccgccccgucaccagcggcugcuuccccaucaugcacgaccgcaccaaaauccgccaacucccaaaccuacuccguggcuaugaacacguacgacucucgacccacaacguaauaaacgccgaagacgcccccggcggcccauacaaaaucggcacaucaggcucaugcccaaacauaacaaacggaaacggcuuuuucgccacaauggccugggccguccccaaaaacgacaaaaacaaaacugccacgaacccccuuaccaucgaaguucccuacaucugcaccgaaggcgaagaucaaauaaccgucuggggcuuucacagcgacaacgaaacccaaauggccaaacuauacggagacucaaaaccccaaaaguucaccucaucagccaacgggguaaccacacacuacgucucgcaaauuggaggcuucccaaaccaaacagaagacggcggacucccccaaagcggaagaauagucgucgacuacaugguccagaaaagcggcaaaaccggcaccauaaccuaccaacgcggaauccuccucccacaaaaagucuggugcgccagcggacgaucgaaaguaauaaaaggcucacucccccuuauuggcgaagcagauugccuacacgaaaaauacggcgggcucaacaaauccaaacccuacuacaccggagagcacgcaaaagcaaucgggaacugccccaucugggucaaaaccccacucaagcucgccaacggcaccaaauaccgaccacccgcaaaacuccugaaagaacgaggcuucuucggcgcgaucgccggauuccuagagggcggcugggaaggcaugaucgcgggcuggcacggguacacgagccacggagcccacggugucgcagucgccgccgaccucaaaagcacccaagaagccaucaacaaaauaaccaaaaaccucaauagccuauccgaacucgaagucaaaaaccuccaaagacucagcggcgcaauggacgaacugcacaacgaaauccuggagcuagacgaaaaaguagacgaccuacgugccgacacaauauccucacaaaucgaacucgccguacuccuaucaaacgaaggaauaaucaacuccgaggacgaacaccuccucgcccucgaaagaaaacuaaagaaaaugcucgggcccucggccguagaaaucggcaauggcugcuucgaaaccaaacacaaaugcaaccaaacgugccucgacagaauagccgccggcacuuucgacgccggcgaauuuucuuuaccaaccuucgacucgcucaauaucacagccgcaagccucaacgacgacggccuagacaaccacaccauccuccucuacuacucaaccgccgccucaucacucgccguaacccuaaugaucgcaaucuuugucguauacauggucucccgcgauaacguaucauguucaaucugccucuga

SEQ ID NO: 215858 - RNA, 1758 nt, Artificial Sequence
  derived and/or modified sequence opt from Influenza B hemagglutinin
augaaagcgaucaucguucugcucaugguugucaccucaaacgcagacagaaucugcacaggaaucacauccucgaacagcccccacguugugaaaacagccacccaaggggaaguaaacguuacaggagucaucccccucaccacaaccccaacaaagucccacuucgcaaaccuaaaaggaacagaaacgagagguaagcucugccccaaaugccucaacugcaccgaccucgacgucgccuuaggacgcccgaaauguaccggcaaaauacccucagccagagucucaauacuacacgaaguccgacccguaaccucaggaugcuucccuaucaugcacgaccgcaccaagauacgccaacucccaaaccugcucaggggcuacgaacacgucagacucaguacccacaacgucaucaaugcagaagaugcacccggaggcccauacaaaauaggaaccucccgcuccugcccgaacauaaccaacggcaacggcuucuucgcaacaauggccugggccguccccaaaaacgacaaaaacaaaaccgcaacgaacccacuaacaaucgagguaccauacauaugcacagaaggagaagaccagauaaccgucuggggcuuccacagcgacaacgaaacacaaauggcaaaacucuacggcgacuccaaaccgcaaaaauucaccagcucggccaauggcguaaccacgcacuacgucucucaaaucggaggauucccgaaccagacugaggacgggggccucccccagagcggacgaaucgucguagacuacaugguccagaaaagcggcaaaacaggcaccaucacauaccaacguggcauccugcucccccaaaaagucuggugcgcaagcggacgaucaaaagugaucaaaggaucacucccccuaaucggcgaagcagacugcuuacacgaaaaauacggcggccucaacaaguccaagccauacuacaccggggaacacgccaaagcaaucggcaacugccccaucugggucaaaaccccacuaaaacuagccaacgguacaaaauaccgacccccagccaaacuacugaaagaacgaggauucuucggcgcaaucgcaggauuccucgagggagggugggaaggcaugauagcaggauggcacggguacaccucccacggcgcacacggagucgccguagccgccgaccuuaagagcacacaggaagcaauaaacaaaaucaccaaaaaccucaacagccuaagcgaacuugaaguaaagaacuuacaacgccuauccggcgccauggacgaacuccacaacgaaauucucgaacuagacgaaaaagucgacgaccuccgcgccgauacaauauccagccaaaucgagcucgcgguccuucucuccaacgaagggauaauaaacagcgaagacgaacaccuccucgcccucgaacgcaaacucaaaaagaugcuaggcccauccgccguggaaauaggcaacgguugcuucgaaacaaagcacaaaugcaaccaaacgugccucgaccgaaucgccgccgggacuuuugacgcaggcgaguucucccuccccaccuucgacucacucaacauaacagccgcgagcuuaaacgacgacggccucgacaaccauaccauacuccuguacuacagcacggcagcauccucccucgccgucacccuaaugauagccaucuucgucgucuacauggucucacgcgacaacguaagcugcagcaucugccucuaa

SEQ ID NO: 215859 - RNA, 1758 nt, Artificial Sequence
  derived and/or modified sequence opt from Influenza B hemagglutinin
augaaagccaucauaguccuacucaugguuguaaccuccaacgccgaccgaaucugcaccggcaucaccaguaguaacucaccccacgucguuaaaacggccacccaaggggaaguaaacgucacaggcgucauaccccuuaccacaacaccgaccaagagccacuucgcaaaccuaaaaggaacagaaacccgcggcaaacucugccccaaaugccccaacugcaccgaccuagacguagcccucggcagaccaaaaugcaccgggaagauucccucagcccgagucuccauucuucacgaaguacgccccgucaccuccggcugcuuuccaaucaugcacgaccgaaccaaaauccgacaacucccaaaccuccucagagguuacgagcacauccgccucucaacacauaacgucaucaacgccgaaaaugcacccggcggcccauacaaaauagggaccuccggcucaugccccaacgucacaaacggcaacggcuucuucgccaccauggccugggcagucccuaaaaacgacaaaaacaaaaccgcaaccaacccccuuaccaucgaggucccguacauaugcaccgaaggugaagaccaaauaaccguauggggguuccacagcgacgacgaaacccaaauggccaaauuauacggcgacucaaaaccccaaaaguucaccagcucggccaacggcgugacuacgcacuacgucagucaaaucggcggguuuccgaaccaaaccgaggacggaggacugccccaauccgggcgcauagucgucgacuacaugguccaaaagucaggaaaaacaggcaccaucacauaccagcgaggcauucuccucccgcaaaaaguauggugugccaguggccgcuccaaagucaucaaaggaucccucccacuaauaggagaggccgacugccuccacgaaaaauacggaggacuaaacaaauccaaaccauacuacaccggcgaacacgccaaagcaaucggcaauugucccaucugggucaaaacaccacuaaaacuugccaacggaacgaaauaccgaccaccagcaaagcuccuaaaagaacgcggauucuucggcgcaaucgccggcuuucucgaaggcggcugggaaggcaugauagccggcuggcacggguacaccagccacggcgcccacggagucgcagucgccgccgaccucaaaagcacacaagaagccauaaacaaaaucacgaaaaaccuaaacagccucagcgaacuggaagucaaaaacuugcaaagacucucaggugccauggacgaacuccacaacgaaauacuggaacuagacgaaaaagucgacgaccuccgcgcagacacgauaucaagccagaucgaacuagcaguacuccucuccaaugaaggcauaaucaacucagaagacgaacaucuccuggcacucgagcgcaaacucaagaaaaugcuagggcccucagcaguagaaauaggaaacggauguuucgaaaccaaacacaaaugcaaccaaaccugccuagacagaaucgcagcaggaaccuucgacgcaggggaguucucacuacccaccuucgacucccugaacaucacagcagccagccuaaacgacgacggccuagacaaccacacaauccuacucuacuacuccacagcagccagcucccucgccgucacccucaugauagcuauauucgucgucuacauggucucccgcgacaacgucagcugcucaaucugccucuaa

SEQ ID NO: 215860 - RNA, 1755 nt, Artificial Sequence
  derived and/or modified sequence opt from Influenza B hemagglutinin
augaaagccaucaucguccuccuaauggucguaacgagcaacgcagaccguauaugcacgggcauaacaucaagcaacuccccacacguagucaaaacagcaacccaaggagaagucaacgucaccgguguaaucccccucaccacaacaccaacgaaaucguacuucgccaaccuaaaggguacgagaacccgcggaaaacugugcccagacugccuaaauugcacggaucuagacguggcccuaggccgacccaugugcguagguacaacccccagcgcgaaagcaucaauccuccacgaaguccgccccgucaccaguggaugcuuccccauaaugcacgaccgcacaaaaauccgacaacuacccaaccuccuaagaggguacgagaaaauacgccuaagcacccaaaacgucaucgacgcagaaaaagccccagguggccccuaccgccucggaaccuccgggagcugcccaaacgccacauccaagaucggguuuuucgccacaauggccugggcaguccccaaagauaacuacaaaaacgccaccaacccgcuaacaguagaaguccccuacauaugcacagaaggggaagaccaaauaaccguuuggggcuuucacagcgauaaaaagacacagaugaaaagccuauacggcgacucaaacccccaaaaauucacauccucagcaaacggagugaccacccacuaugucucccaaaucggagacuuccccgaccaaaccgaagacggaggacuaccacagagcggacgcauaguugucgacuauaugaugcaaaaacccgggaaaaccggcaccauaguguaccaacgcggcguacugcucccacaaaaaguuuggugcgcaagcggccgcucaaaagucaucaaaggcucgcucccacuaauaggcgaagccgacugccuacacgaagaguacggcggucucaacaaaucgaaaccguacuacaccggcaaacacgccaaagccauaggcaacugccccauaugggucaaaacaccccucaagcucgcaaacggcaccaaguaccggccaccagccaaacugcuaaaagaacgaggauucuucggagcaauagcgggauuccucgaagguggcugggaaggcaugaucgcuggcuggcacggguacaccagccacggcgcccacggagucgcagucgcagcagaccucaaaucaacccaagaagccauaaacaaaaucacaaagaaccuaaacagccuaucagaacucgaagucaaaaaccuacaaaggcuauccggagcaauggaugaacuccacaacgaaauacuagagcucgacgaaaaagucgacgaccuacgagcagacacaaucucgagccaaauagaacucgcaguccuccucucaaacgaaggcauaauuaacagcgaagacgagcaccuucucgcccucgaacguaagcucaagaaaaugcucgggcccuccgccgucgacauaggcaacggcugcuucgaaaccaaacauaagugcaaucaaaccugccucgacaggauagcggccggaaccuucaacgcgggcgaguucagccuaccgaccuucgacucccucaacaucacagcagccagccugaacgacgacggacuagacaaccacaccauacuucuauacuacagcaccgccgccagcucacucgccgucacacucaugcuagccaucuucauagucuacaugguuucacgcgacaacguuuccugcagcaucugccuguaa

SEQ ID NO: 215861 - RNA, 1755 nt, Artificial Sequence
  derived and/or modified sequence opt from Influenza B hemagglutinin
augaaagccaucauaguacuccuaauggucgucacgagcaacgccgaccgcauaugcaccggaaucacaucaagcaacagcccacacguagucaaaaccgccacacaaggcgaaguaaacgucacgggcgucaucccacuaacaacaacaccuaccaaauccuacuucgcgaaccucaaaggaacucgcacccgcggcaaacucugcccagacugccucaacugcacggacuuagacguagcccuaggcagaccaaugugcgucggaaccaccccaagcgcaaaagcgucaauacuccacgaagugagaccagucaccagcgggugcuuccccauaaugcacgaccgcacaaaaauccgacaacucccaaaccuccuacgcggauacgaaaagaucagacuaagcacccaaaaugucaucgacgccgaaaaagccccgggcggccccuaccgacucggcacgagcggauccugccccaacgccacaagcaagauuggauucuucgccacgauggcaugggcagucccgaaagacaacuacaaaaacgccacaaauccccuaacagucgaagucccauacauaugcacggaaggagaagaccaaauaaccguguggggauuccacagcgacaacaaaacccaaaugaaaagccucuacggugacucaaacccccaaaaauucacgucaucagccaacggcgucaccacucacuacguaucccaaaucggcgacuucccugaccaaaccgaagacgggggccuaccccagagcgggcgaauagucguggacuacaugaugcaaaaacccggcaaaaccggaacgaucguguaccagcgaggaguccuucucccacaaaagguauggugcgcgagcggccgcucaaaaguaaucaaaggcucccucccacuaauaggagaagccgacugcuuacacgaagaauacggcggacucaacaaauccaaacccuacuacaccgggaaacaugccaaagccauaggaaacugcccuaucuggguaaagacaccacucaaacucgcuaacgggaccaaauacagaccucccgcaaaacuacuaaaagaacgcggguucuucggcgcaauagcggguuuccucgaaggaggaugggaaggcaugaucgccggcuggcacggguacacaagccacggcgcccacggggucgcgguagccgcagaccucaaguccacucaagaagcaauaaacaaaauaacuaaaaaccuaaacagccuaagcgagcuugaagucaagaaucuccaaagacucucaggcgcaauggaugaacugcacaaugaaauacucgaacucgacgaaaagguagacgacuuacgcgcagacacaaucucaucccaaaucgagcuagcggucuugcucucaaacgaaggcauaaucaacucagaagacgagcaucugcuagcacucgaacgcaagcucaagaaaaugcucggacccucggcagucgacauaggaaacggcugcuucgaaaccaaacacaaaugcaaccaaacaugccucgacagaaucgcagccggcaccuucaacgcaggcgaguucucacucccuacguuugacucccuaaacaucacagccgcgagucugaacgacgauggacucgacaaccacacaauccuccuauacuacagcacggccgccagcucacucgccgucacacuaaugcuagccauauuuaucgucuacaugguaucccgagacaacguaucaugcucaauaugucucuaa

SEQ ID NO: 215862 - RNA, 1755 nt, Artificial Sequence
  derived and/or modified sequence opt from Influenza B hemagglutinin
augaaggcaaucauaguccuccuaauggucgucacaagcaacgccgaccgcauaugcaccggcaucaccuccucaaauuccccacacgugguuaaaacugccacccagggagaagucaacgucacaggugucaucccccuaacaaccaccccgaccaaaucauacuuugccaaucucaaaggcacacgcacucgaggaaaacuaugcccagacugccuaaacuguacagaccuagacguagcccuaggaaggcccaugugcguagguaccaccccaagugcaaaagcauccauccuccacgagguaagaccggucacaagcggaugcuuccccauaaugcacgacagaacaaaaauacggcaacuacccaaccuccugcgcggcuacgagaaaauccgacucucaacacaaaauguuauagacgcagaaaaagccccgggaggccccuaccgccucggaacaaguggcucuugccccaacgcaacaagcaagaucgguuucuucgccacaauggcgugggcagucccuaaagacaacuacaaaaacgccacgaacccgcaaaccgucgaaguaccauacaucugcacagaaggagaagaccagauaacagucuggggauuccauagugacaacaagaaccaaaugaaaagccucuacggggacucgaacccgcaaaaauucacaagcucagccaacggcguaaccacccacuacgucucgcaaauaggcgacuucccggaccaaaccgaagacggaggacuaccccaauccggccgcauaguaguggacuacaugaugcaaaaacccggaaagaccggaacgaucgucuaccagcgcggaguccuccucccacaaaaagucuggugcgcaagcggacgcagcaaagucaucaagggaucacucccacucauaggcgaagccgacugccuacacgaagaauacggcggacucaacaaaucuaaaccauacuacacugggaaacacgccaaggccauaggcaauugcccgauauggguaaaaaccccucucaaacucgccaacggaaccaaauacaggccacccgcaaagcuacuaaaagagcgcggguucuucggcgcgaucgcaggcuuccucgaaggcggaugggagggaaugaucgcgggcuggcacggauacaccucccacggcgcacacggcgucgccgucgccgccgaccucaaauccacacaagaagccauaaacaaaauaaccaaaaaucucaacucccuuuccgagcucgaagucaaaaaccuacaacggcucucaggcgcaauggaugaacuacacaacgaaauacucgaacuagacgaaaaaguggacgaccugcgagcagacacaaucuccucacaaauagagcucgccguccugcucuccaacgaaggcauaaucaacagcgaagacgagcaucuccuugcacuagagcgaaaacuaaagaaaaugcucggacccuccgcagucgauauagggaacggcugcuucgaaacaaaacacaagugcaaccaaacaugccuggaccgcaucgcugccgggaccuucaacgcgggcgaguucucccuccccacauucgacucgcucaacauuacagccgcaagccuuaacgacgacggccuagacaaccacaccauacuccuguacuacagcaccgcagcauccucauuagcaguaacccucaugcucgccauauucaucguauacauggucucacgcgacaacgugucaugcagcaucugccucuaa

SEQ ID NO: 215863 - RNA, 1755 nt, Artificial Sequence
  derived and/or modified sequence opt from Influenza B hemagglutinin
augaaggccauaaucguacuacucaugguaguaacaagcaacgccgaccgcaucugcaccggcauaaccucauccaacuccccacacguagucaaaacagccacccaaggcgaaguaaacgucacgggcguaaucccccucaccaccacaccaacaaaaucguacuucgccaaccuuaaaggcacgcgcacacgaggcaaauugugucccgacugccuaaauugcaccgaccuggacguggcccuaggccgccccaugugcgugggaacgacacccagcgcaaaagccagcauucuacacgaagugcgaccagucaccuccggaugcuuccccauaaugcacgaccgaaccaaaauccgacaacugccaaaccuucuccgcggguaugagaaaauacgacuaaguacgcaaaacgucaucgacgccgaaaaggccccgggugggcccuaccgacugggcacaagcggauccugcccaaacgccacaagcaaaaucggcuucuucgccacgauggcaugggcaguccccaaagauaacuacaaaaacgcaacaaacccgcaaaccgucgaaguaccguacauaugcaccgaaggcgaagaccaaauaaccgucuggggguuccacagcgacaacaaaacccaaaugaaaagucuauacggggacucgaacccccaaaaguucaccagcuccgcaaacggagucaccacacacuacgucucccaaaucggugacuucccagaccaaaccgaagacggaggccuaccccaauccggccgcaucgucgucgacuacaugaugcaaaaacccggaaagaccggcaccaucguauaccaacguggcguccuucucccacaaaaaguauggugcgccucaggacgcuccaaagugauaaaagguucccuaccacucaucggugaagcagacugccuacacgaagaauacggcggacucaauaaaucaaaacccuacuacaccggcaaacacgccaaggccauaggcaauugcccaaucuggguaaaaaccccgcucaaacuugcaaacggaacaaaauaccgaccaccggccaagcucuuaaaagaaagaggauucuucggcgccaucgccggcuuccucgaaggcggaugggagggcaugaucgccggcuggcacggguacaccagccauggcgcacacggagucgccgucgcagccgaccucaaaagcacacaagaggccauaaacaaaaucacgaaaaaucucaacagccucuccgaacuagaagucaaaaaccuccaacgccucucaggcgcaauggacgaacugcacaacgaaauacucgaacucgacgaaaaaguagacgaccuacgcgcagacacaauaucaucccaaaucgaacucgcaguccugcucucaaacgaaggcaucaucaacagcgaagacgagcaucugcuagcgcucgaacgaaaacucaagaaaauguuaggccccuccgcagucgacaucggcaacggaugcuuugaaacuaaacacaaaugcaaccaaacaugccuugaccgcaucgcagcagguaccuucaacgcaggcgaguucucccuccccaccuucgacucacuaaacauaaccgcagcaagccuaaacgacgacggacuugacaaccauacaauccuccucuacuauuccacagccgcaagcucccucgcugucacgcuaaugcucgccauauucaucguguacauggucucacgcgacaacguguccugcuccauaugccuauga

SEQ ID NO: 215864 - RNA, 1755 nt, Artificial Sequence
  derived and/or modified sequence opt from Influenza B hemagglutinin
augaaggccauaauaguacuccuaauggucguuacgucaaacgccgaccgcauaugcaccggcaucacaucaagcaacucaccccacgucguaaagaccgcgacccagggagagguaaaugucacaggcguaaucccgcucacaaccacacccacaaaaucgcacuuugccaaccuaaaaggaacgcaaacccgcggcaaauuaugccccaacugcuucaacugcaccgaccuagacguggcccucggacgacccaaaugcaugggcaacaccccaagcgcaaaagucagcauacuccacgaggugaaaccugcaacuuccgggugcuuccccaucaugcacgaccgcaccaaaauccgccaacuacccaaccuacuccgcggguaugaaaacauccggcucagcacaagcaacgucaucaacacagaaacagccccaggaggacccuacaaagugggcacgagcggaucauguccaaacguagcgaacggcaacggauucuucaacaccauggcaugggucaucccaaaagacaacaacaaaacugcaauaaacccggucaccguagaggucccguacauaugcucagaaggagaagaccagauaaccguguggggauuccacucagacgacaagacccagauggaacgccuauacggagacucgaacccacaaaaauucacaagcucagccaacggagucacaacacacuacgucucacaaauaggaggcuucccaaaccaaacagaagacgagggacucaaacaauccggacgaaucgucgucgacuacaugguacaaaagcccggcaaaacaggcaccaucguauaccaacgaggcauccuacuaccucaaaaagucuggugcgccagcgggcgaucgaaagugaucaagggcucucucccgcucauaggcgaagccgacugccuccacgaaaaauacggcggacuaaauaaaucaaagcccuacuacaccggggaacacgccaaggcaauagguaacugcccaauauggguaaaaacuccacucaagcuagcaaacggcaccaaauaccggccacccgccaaacuacugaaagaacgaggauucuucggcgccauagccggauuccucgagggcggaugggaaggcaugaucgccggcuggcacggcuacacaagccauggcgcgcacggggucgccgucgccgccgaucucaaguccacacaagaagccaucaacaaaaucacaaagaaccuaaacuaccuaagcgaacuggaagucaaaaaccuccaacgacucuccggagcuaugaacgaacuccacgacgaaauacucgaacucgacgaaaaagucgacgaccuccgcgcagacacaaucucaucccaaaucgagcucgccguccuacucucaaacgaaggcauaaucaacagcgaggacgagcaccuacuagcacuagaacgcaagcucaagaaaaugcucggccccuccgccguagaaaucggcaacggaugcuucgaaaccaaacacaaaugcaaccaaacgugcuuagacagaauagccgccgggaccuuuaaugcaggcgacuuuucccuccccaccuuugacucccucaacaucacagcagcgucccucaacgacgacgggcucgacaaccacacaauacuacuguacuauagcacagccgcgagcucccuagccgucacgcuaaugaucgcaaucuucaucguauauaugguaucacgggacaacguauccugcaguaucugccuguaa

SEQ ID NO: 215865 - RNA, 1755 nt, Artificial Sequence
  derived and/or modified sequence opt from Influenza B hemagglutinin
augaaagccauaaucgugcuccugaugguagugacaagcaacgcagaccgcauaugcacgggaauaacaucauccaacagcccacacgucgucaaaacugcgacccaaggagaggucaacgucacaggcgugaucccgcucacgaccacccccacacguucccacuucgccaaccucaaaggcacacaaacccgcggcaaacuaugcccaaacuguuucaacugcaccgacuuagacguagcccuaggcagacccaagugcaugggcaauauucccagcgcaaaaguaagcauacugcacgaaguaaaaccggucacgagcggguguuuuccuaucaugcacgaccgcaccaaaauacgacaacuccccaaccuacuacgcggguacgagaacauccgccuguccacaagcaacgucaucaacgccgaaacggcaccaggcggucccuacaaaguaggcaccuccggaagcugccccaacgucgccaacagaaacggauucuucaacacgauggcguggguaaucccgaaagacaacaacaaaaccgcaaucaaccccgucacaguugaggucccauacauaugcucggaaggcgaagaccaaauaaccguguggggcuuccacagcgacgacaaaacccagauggaacgccuguacggcgauucaaauccacaaaaauucaccucaucggcaaauggaguaacaacacacuacgucucacaaauaggaggauuccccaaccagaccgaagacgaaggccuaaaacaaagcggacgaauagucguggauuauaugguacagaaacccgggaaaacuggaacgaucguguaccaacgaggcauccuccucccgcaaaaagucuggugcgcaagcgggcgcuccaaagugaucaaaggaucccucccccucaucggcgaagccgauugccuccacgaaaaguacggcggccucaacaaaucgaaaccauacuacaccggagaacaugccaaagccauaggaaauuguccgaucugggucaagacuccccuuaagcucgcgaacgggaccaaguacagaccacccgcaaaacuccuaaaagagcgaggauucuucggagccaucgcaggcuuucucgaaggugggugggaaggcaugaucgcaggcuggcacggauacaccagccacggagcccauggaguagcagucgcagccgaucucaaaaguacgcaagaagccaucaacaaaaucacgaagaaccucaacucccucuccgagcucgaagucaagaacuuacaacgacuaucaggagcgaugaacggucuacacgacgaaauucuagaacuagacgaaaaagucgacgacuugcgcgcagacaccaucuccucacagauugaacuagcaguccuacucuccaacgagggcauuauaaacagugaagaugaacaucugcuagcgcucgagcgcaaacucaagaaaaugcucggccccucggccguggaaaucggaaacgguugcuucgaaaccaaacacaaauguaaccaaacaugccuagaccgaaucgcggccggaaccuucaacgcgggcgacuucucacuaccgacauucgacucgcugaacaucacagccgcaagccugaacgacgaugaccucgacaaccacaccauacuacuauacuauagcacagccgcaagcucacucgcagucacacucaugaucgcaauauuuauaguauacauggucucaagagacaacguaaguugcagcaucugccuguga

SEQ ID NO: 215866 - RNA, 1755 nt, Artificial Sequence
  derived and/or modified sequence opt from Influenza B hemagglutinin
augaaagccaucaucguccuccuaauggucgucaccuccaacgccgaccggauaugcaccggaaucaccucaaguaacucaccucacgugguaaaaaccgcaacccaaggcgaagucaacgucaccggaguaauaccgcuaacgacaacccccacuaaaucauacuucgcaaaccucaaaggcaccaaaacgcgcggaaaacucugccccgacugccucaacugcaccgaccuagacgucgcucuaggccggccaauguguguagguacaacccccuccgcaaaagccagcauccuacacgaaguccgcccggucaccagcggaugcuuccccauaaugcacgaccgcacaaaaauccgccaacucgccaaccuccucagaggguacgaaaacauccgccuaagcacacaaaacgucauagacgcagaaaaggccccgggaggaccguacagacucggcacgagcggaagcugucccaacgccacaucgaaaagcggauucuucgccacgauggcaugggccguccccaaagacaacaacaaaaacgcaacaaacccacucaccgucgaagucccauacauuugcgccgaaggcgaagaccaaaucaccgucuggggcuuccacucagacgacaaaacucaaaugaaaaaccuauacggagacaguaauccacaaaaguucacgagcuccgcaaacgguguaacaacacacuacgucucacaaaucggagguuucccagaccaaaccgaagacggaggccucccccagagcggccgcaucgucguagacuacaugaugcaaaaacccggaaaaacaggcaccauaguguaccagagaggcguccuacuaccccaaaaagucuggugcgcaagcggacggucuaaagucaucaaaggcucacucccacucauaggagaggccgacugccuacacgaaaaauacggcggacucaacaaaagcaaacccuacuacaccggagaacacgccaaggcaaucggcaacugcccaauuugggucaaaacaccacuaaaacuagcaaacggaaccaaauacagaccgccagcuaaacuccuaaaagagcgcggauucuuuggcgccaucgcuggauuccucgagggcggcugggagggcaugauagcaggauggcacggcuacacaagccacggcgcacacgguguagcagucgccgccgaccuaaaaagcacccaagaagcuauaaacaaaaucaccaaaaaucuaaacagccucagcgagcucgaagucaaaaaccuacaaaggcucucuggcgccauggacgaacuacacaacgaaauacucgaacucgacgaaaagguagacgaccucagagcagacacaaucucaagccaaauagagcucgcgguacuacuuucuaacgaaggcaucaucaacucagaagacgaacaccuccucgcccucgagcgcaagcucaagaaaaugcucggcccaucagccgucgacauaggaaacggcugcuucgaaacaaaacacaaaugcaaccaaaccugccucgaccgaauagcggcaggcaccuuuaacgccggcgaguucucccucccgaccuucgacucccucaacaucaccgcagccagccugaacgacgacggcuuagacaaccacaccauacuacucuacuauucaaccgccgccagcucacucgccgucacacuuaugcucgcaaucuucauagucuacaugguaucccgcgacaacguaagcuguuccaucugccucuaa

SEQ ID NO: 215867 - RNA, 1755 nt, Artificial Sequence
  derived and/or modified sequence opt from Influenza B hemagglutinin
augaaggccaucaucguacuccuaauggucgucaccuccaacgccgacagaaucuguacaggcaucacuuccagcaacagcccacacguagucaaaaccgccacccaaggcgaagucaacguaaccggcgugaucccacuuaccaccacucccacaaaauccuacuucgccaaccucaaaggcacaaaaacccgagguaaacugugcccagacugccuaaauugcaccgaccuggacgucgcccuaggccggcccaugugcgucggcacgaccccuagcgccaaagccuccauucuccacgaaguccgccccguaaccucaggcugcuuccccaucaugcacgaccgaacaaaaauacgacaacuagccaaccuacuaagaggcuacgaaaacauccgucugucaacgcaaaacguaaucgacgccgaaaaagcacccggaggacccuaucgccuaggcacauccggcuccugcccaaacgccacaagcaaauccggauucuucgcgacgauggccugggcagucccgaaagacaacaacaaaaacgcaacaaacccccuuaccgucgaaguccccuacaucugugccgaaggcgaagaccagaucaccguguggggcuuccacagcgacaacaagacccaaaugaaaaacuuauauggagacuccaacccccaaaaauucacgagcucagcuaacggagugaccacccacuacguaucccaaaucgguggcuuccccgaccaaaccgaagacggcggccuaccacaguccggccgaauagucguugacuacaugaugcaaaaaccaggaaaaacaggaacaaucguauaccaacgcggcguccuacuaccacaaaaggucuggugcgcaucuggucgcuccaaagucaucaagggaucgcucccccucaucggcgaagccgacugccuacacgaaaaauacggaggucucaacaaaucaaaaccguacuacaccggcgaacacgccaaagccaucggaaacugucccaucuggguaaagaccccacucaagcucgcuaacggaaccaaauacagacccccagcuaagcuccucaaagaacgcggauucuuuggcgccaucgcgggcuuccuagaaggagguugggaaggcaugaucgccggcuggcacggcuacacuucccauggcgcccacggagucgcagucgccgccgaccucaaguccacccaagaagccauaaacaaaaucaccaaaaaccuaaacucccucuccgagcuggaagucaaaaaccuacaacgacuauccggcgcuauggacgaacugcacaacgaaauccuugaacucgacgaaaaagucgacgaccuacgcgccgacaccaucagcagccagaucgaacucgcgguccuacucucgaacgaaggcauaaucaacuccgaagacgaacaccuccuugcccucgaacgaaaacucaagaaaaugcucggccccuccgcuguggacaucggcaacgguugcuucgaaacaaaacacaaaugcaaccaaaccugccuugaccgcaucgccgcaggaacauucaaugccggagaguucucgcucccaaccuucgacucccuaaacaucaccgccgcgagccugaacgacgacgggcucgacaaucacaccauacuauuauacuacagcacagcagcaagcucccucgcagucacccuaaugcuagccauauucauagucuacaugguuucucgcgacaaugugagcugcucaauaugccuauga

SEQ ID NO: 215868 - RNA, 1755 nt, Artificial Sequence
  derived and/or modified sequence opt from Influenza B hemagglutinin
augaaagcuauaaucguacuccugaugguagucacaagcaacgccgaccgcaucugcaccggcauaaccucaagcaacagcccacacgucgucaaaacagcaacccaaggcgaagucaacgucacgggaguuaucccacucacgaccacaccaacgaaaucauacuucgccaaccuaaaaggcacacgaacgcgugguaaauuaugcccagacugccucaacugcacggaccuggacguugcccugggccggcccaugugcgugggcacaacccccagcgcaaaagcgagcaucuuacacgaagugaggccgguaacguccggaugcuuccccaucaugcacgacagaaccaagaucaggcaacuacccaaccuccuccgaggauacgaaaacauacgccuaucaacacaaaacgucaucgacgcagaaaaggcaccaggagggccauaccgauuaggcaccuccggcuccugcccaaacgcuacaagcaaaauaggauucuucgccacaauggcgugggcaguaccaaaagacaacuacaaaaacgcuacaaacccgcucacagucgaagucccguauaucugcacagagggcgaagaccaaauaaccguauggggguuccacagcgacaacaaaacccaaaugaagaaccuauacggagacuccaauccccaaaaauucacaagcucggccaacggaguaacaacacacuacguaucacaaaucggagacuuccccgaucaaacugaagacggaggccuaccacaauccggacgcauagucgucgacuacaugaugcaaaaacccggaaaaacaggcacaauaguauaccagcguggaguccugcucccgcaaaaaguauggugcgcaagcgggcgcucgaaaguaauuaagggcucccucccgcuuauaggagaagcagacugucuccacgaaaaauacggaggacucaauaagucaaagccauacuacaccggcgaacacgccaaggcgauuggaaacugccccaucugggucaaaaccccacucaaacucgcaaacgguacaaaguacaggcccccggccaagcuccugaaagaacgcggcuucuucggcgcaaucgcaggcuuucucgaaggcggcugggaaggaaugaucgccggcuggcacggguacaccagccauggcgcccacggagucgcggucgcagccgaccugaaaagcacacaagaggcaauaaacaaaaucacgaaaaaccucaacagucuguccgaacucgaagucaaaaacuuacaacgacucuccggcgcaauggacgaacugcacaacgaaaucuuagaacuagacgaaaaaguagaugaccuacgagcagacacgaucucgagccagauagaacuagcaguacuacucuccaaugaggguaucaucaacagcgaagacgaacaccuacuugcacucgagcgcaaacuaaagaaaaugcuagggcccucagcaguagacauaggcaacggcugcuucgagacuaagcacaaaugcaaccaaacaugccuggacagaaucgcagccggaacauucaacgcgggcgaguucucacuacccaccuucgacucccucaacauuacggccgcaagccuaaacgacgacgggcucgacaaccacaccauacuacuauacuacagcacggccgcgagcucgcuagcagucacccuaaugcucgcaaucuucaucguguacaugguaucacgcgacaacgucaguugcagcaucugccuguaa

SEQ ID NO: 215869 - RNA, 1758 nt, Artificial Sequence
  derived and/or modified sequence opt from Influenza B hemagglutinin
augaaagcaaucauaguccuccucauggucguaaccucaaacgcagaccgcaucugcaccggcaucacaagcucaaacucgccccacgucguaaaaaccgccacccaaggcgaagucaacgugacaggggugauuccccuaacaaccacccccacuaaaagccacuucgcaaaucuaaaaggcaccgaaacccgcgguaaacucugccccaaaugccuaaacugcaccgaccucgacgucgcacuaggccgacccaaaugcaccggcaaaauccccuccgcccgggucucgauccuucacgaaguccgccccgucaccuccggaugcuucccaaucaugcacgaccgcaccaaaauucgccaacucccaaaccuacuccgcggcuaugaacacaucagacucuccacccacaacgucaucaacgccgaaaacgcacccggcggaccauacaaaaucgguacgucaggaagcugcccaaacgucaccaacggcaacggcuucuucgcaaccauggcaugggccguccccaaaaacgacaaaaacaaaaccgcaacaaacccccucacaauugaaguccccuacauaugcacagaaggggaagaucaaaucaccguauggggcuuccacagcgacaacgaaacccagauggcaaaacucuacggcgacucaaaaccacaaaaauucaccuccagcgcaaacggcguaacaacccacuacgucucacaaaucgggggcuuccccaaccaaacagaagacgguggucucccccaaagcggaaggaucguagucgacuacaugguacagaaaagcggcaaaacaggcacgaucaccuaccaacgagggauccugcucccacaaaaagucuggugcgccagcggccgcuccaaaguaauuaaaggcucucucccacucauaggcgaagccgacugccuccacgagaaauacggaggccucaacaaaucaaaacccuacuacaccggcgaacacgcaaaagccauuggaaacugcccgauuugggucaaaacaccacucaaacucgcaaacggaacaaaauaucgaccacccgcgaaacuccucaaagagagggguuucuucggagccaucgccggcuuccucgaaggcggaugggaaggcaugaucgcaggauggcacggauacacaucccacggcgcgcacggcgucgcggucgcagccgacuuaaaauccacccaagaagccaucaacaaaauaaccaaaaaucuaaacagccucagugagcucgaaguuaaaaaccuccaacggcuaucaggcgccauggacgaacugcacaacgaaauccucgaacucgacgaaaaagucgacgaccuucgagcagacacaauauccucccaaauagaacuagcaguccuccuaagcaacgaaggcaucauaaacagcgaagacgaacaccuccuggcacucgaacgcaaacucaagaaaaugcucggaccuucugccgucgaaaucggcaacggaugcuucgaaaccaaacacaaaugcaaccaaacaugccuagaccgcaucgccgccgguacguucgacgcaggcgaguucucacuccccacuuucgacucccucaacauaacggcagccagccucaacgacgacggacucgacaaccacaccauucuacuauacuacuccacggccgcaagcucccuagccgucacccucaugaucgcaaucuucgucguauauauggucagccgugacaacgucagcuguucaauaugccuauaa

SEQ ID NO: 215870 - RNA, 1758 nt, Artificial Sequence
  derived and/or modified sequence opt from Influenza B hemagglutinin
augaaagccaucaucguacuccucaugguaguaaccuccaacgcggacagaaucugcaccggaauaaccuccagcaacucgccccacgucgugaaaacugcaacacaaggcgaagugaacguaaccggcgucauacccuugaccacaacccccacaaaaagccacuucgcaaaccuaaagggcacagaaaccaggggcaaacuauguccaaaaugccuuaacugcacagaccucgaugucgcgcuaggccgacccaaaugcaccggcaaaauccccucugccagggucucaauccugcacgaagucagacccguaaccucaggcugcuucccaaucaugcacgaccgcacaaaaauacgccaacuaccaaaccuacuccggggcuacgaacacaucagauuaucaacacauaacgucaucaacgccgaaaacgcgcccggcggcccauauaaaaucggaaccucaggcuccugcccaaacgucaccaacggaaacgguuucuucgcgaccauggccugggccguacccaaaaacgacaaaaacaaaacggcaacaaacccacuaacaauagaaguccccuacaucugcacagaaggcgaagaucaaauaaccgucuggggcuuccauagcgaugaugaaacacagauggcaaaacuauacggcgacucaaaaccccaaaaauucacaaguucagccaacggcgucaccacccacuacgucucccagauaggaggauucccgaaccaaacagaagacgggggccuaccccaaagcggccguaucguaguagacuacaugguacaaaagagcggaaaaacgggcaccaucacauaccaacgcgggauccugcucccccaaaagguauggugcgcaucagggcgcucaaaaguaauaaaaggcucccucccccugaucggcgaagccgacugccugcacgaaaaauacggcggacuaaacaaauccaaaccauacuacaccggagaacacgccaaggcuaucggcaacugccccauaugggucaaaacaccccuaaagcucgccaacgggaccaaauaccgucccccagccaaacuccuaaaagaacgcggcuucuucggcgcaaucgccggauuucucgagggcggaugggaaggcaugauagcaggauggcacggcuacacaagucacggcgcccauggcgucgcggucgcggcagaccuuaaauccacccaagaggccaucaacaaaaucaccaaaaaccuaaauagccucagcgagcucgaagucaaaaacuuacaaagacucucgggagcgauggacgaacuacacaacgaaauacucgaacuagacgaaaaagucgacgaccuccgagccgacacgaucucgagccaaaucgagcucgccguccuccucuccaacgaaggcauaaucaacagcgaagacgagcaucugcuagcacucgagcguaaacuaaagaaaaugcucggccccucagcagucgaaaucggcaacggcugcuucgaaacaaaacacaaaugcaaucaaacgugccucgacagaauagcagccgggaccuucgacgcgggagaguucucacuccccaccuucgacucacuuaacauaacagcagcaagccuaaacgacgacggacucgauaaccacaccauacuacuguacuacuccacagcugcauccucacucgcaguaacgcucaugauagccaucuucgucgucuacauggucucaagagacaacguuuccugcucaauuugcuuguga

SEQ ID NO: 215871 - RNA, 1752 nt, Artificial Sequence
  derived and/or modified sequence opt from Influenza B hemagglutinin
augaaagccauaaucguccucuuaauggucguaacuucuaacgccgacaggauaugcaccggaaucacaagcucaaauagcccccacgucgucaaaaccgccacacaaggcgaagugaacguaaccggggucaucccacuaaccacaacccccaccaaaucccacuucgcaaaccucaaaggcaccaaaacccgcggcaaacuuugccccaauugucuaaacugcacagaccucgacgucgcacucggccgaccaaugugcgucggcacaacccccucagccaaagccagcauccuacacgaaguccgacccguaaccuccggaugcuuccccaucaugcacgaccgaacaaaaauccgacagcucccaaaccuccuucgcggauacgaaaacauccggcuauccacacaaaacgugauaaacgccgagagagcaccuggaggcccauaccggcucggaaccucaggcuccugccccaacgugacaucucgcgacggcuucuucgccaccauggccugggccguacccagggacaacaagaccgccaccaacccgcucacgguagaagucccauacauaugcacaaaaggcgaagaucaaauaacagucuggggguuccacagcgacaacaaaacccaaaugaaaaacuuguacggggacuccaacccccaaaaguucaccucaucugccaacggcgucacaacgcacuacguaucacaaaucggcggcuuccccaaucagaccgaagacggcgggcuaccccaaagcggacgcauagucguagacuacaugguccaaaagcccggaaaaacaggcaccauaguguaccaaagaggcguccuucuaccccaaaaagucuggugcgcaagcggacgcagcaaagucaucaaaggaucacuaccgcucauaggggaagccgacugucuccacgaaaaauacggaggacuaaacaaaucaaaaccauauuacacaggagagcacgccaaggcaaucggcaacugcccaaucugggucaaaacaccccucaaacuagccaacggaaccaaauaccgcccacccgcaaagcuccuaaaagaacgcggcuucuucggcgcgauagcaggcuucuuagagggcgggugggaaggaaugauugccggcuggcacgguuacaccucacacggcgcacacggggucgccgucgcagccgaccucaaauccacccaagaagccaucaacaaaauaaccaaaaaccuuaacucccucagcgaacuagaagugaaaaaccuccaacggcucuccggcgccauggacgaacugcacaacgaaauccuugaacuagacgaaaaaguagacgaccuccgcgcugacacaaucagcucccaaaucgaacuagccguacuacucuccaacgaaggaauaaucaacagcgaggacgaacauuuacucgcacucgagcgcaaacucaagaaaaugcucgggcccuccgccguagacaucggcaacggcugcuucgaaaccaaacacaaaugcaaccagaccugccucgaccgaaucgccgcuggcacauucaaugcaggcgaguucucacuccccacauucgacucacuuaauauaaccgccgccagccuaaacgaugacggacucgacaaccacaccauacuccuauacuacucaaccgccgcgucaucacucgccguaacucuaaugaucgcgaucuucauaguauacauggucagccgcgauaacgucagcugcagcaucugccucuaa

SEQ ID NO: 215872 - RNA, 1752 nt, Artificial Sequence
  derived and/or modified sequence opt from Influenza B hemagglutinin
augaaagcaaucaucguacuacuuauggucguaaccucaaacgccgaccgaauaugcaccggcauaaccagcuccaacucaccccaugucgucaaaacugccacacaaggagaagugaacguaaccggugucaucccccugacaaccacaccgacaaaaagucacuucgcgaaccucaaaggcaccaagacccgcggcaaacuaugcccaaauugucugaacugcaccgaccucgauguagcgcucgcacgccccaugugcgucggcaccacccccuccgccaaagccagcauccuucacgaagucagaccggucacauccggaugcuucccaaucaugcacgaccgcaccaaaauacgccaacucccgaacuuacucagaggcuacgaaaacauccgacucucaacccagaacguaauaaacgccgaacgcgccccaggcggucccuaucgacuagggaccuccggaucgugcccgaacguaaccucgagagacggcuucuucgcaaccauggccugggccgucccaagggacaacaaaacggccacaaacccacuaacaguagaagucccauacaucugcacaaaaggagaagaccaaauuaccguauggggcuuccacuccgacaacaaaacccaaaugaagaaccucuauggagacucaaacccccaaaaguucacaagcucagcaaacggcguaacaacccacuacgucucacaaaucggcggauucccaaaccaaaccgaagacgggggcuuaccucaaagcggaagaaucgucguagacuacaugguucaaaagcccggcaaaacaggcacaaucgucuaccaacgcgggguccuccuaccccaaaaagucuggugcgccagcggccgcucaaaagugaucaagggaucacucccacuaauaggagaagcagacugccuacacgagaaauacggcggccugaacaaaucaaaaccauacuauaccggagaacacgccaaagcaauaggcaauugccccauaugggucaaaaccccgcuaaaacucgcaaacggaacaaaguacagacccccagccaaacuccugaaagaacgcggcuucuucggcgcgaucgcaggcuuucucgaaggcggcugggaaggcaugaucgcaggauggcacggcuacaccucccauggcgcccaugggguagcggucgccgccgaccucaagaguacacaagaagccauaaacaaaauuaccaaaaaccucaacucccucuccgaacucgaagucaaaaaccuacaacgccucuccggagcaauggacgaauuacacaaugaaauccucgaacucgacgaaaaggucgaugaccuccgcgcggacacaaucucuagccagauagaacuugccguccuacucucgaacgagggcauaaucaacagcgaagacgaacaccuacuagcgcucgagcgcaaacucaagaaaaugcuaggccccuccgccguagauaucggcaacgggugcuucgaaaccaaacauaagugcaaucaaacaugccuggacagaaucgcagcaggcacauucaacgcaggagaguucucacuuccaaccuucgacucacuaaacaucaccgcugcaucccugaacgaugacgggcucgacaaccacaccauacuucuauacuauagcacggccgccagcucgcucgcggucacacucaugaucgccaucuucaucguauacaugguuucaagagacaacgugagcugcagcauaugucuguaa

SEQ ID NO: 215873 - RNA, 1755 nt, Artificial Sequence
  derived and/or modified sequence opt from Influenza B hemagglutinin
augaaagcaauaaucguccuucuaaugguggucacgagcaacgcagaccgaaucugcacaggcauaacaucauccaacuccccacacguagucaagaccgccacccaaggcgaagucaacgucaccggcguaaucccccuaacaaccacacccaccaaaucuuacuucgccaaccuaaaaggcacaaaaaccagaggaaaacucugcccagacugccucaacugcaccgaccuagacguugcccucggaagacccaugugcguaggcacaacaccaagcgcaaaagcgagcauccuucacgaagucagaccgguaacauccggaugcuuccccauaaugcacgacaggaccaaaaucagacaacuggccaaccuacuacgaggauacgaaaacauacgccugagcacacaaaacgucauagacgccgaaaaagcacccggcggaccauaccgccugggcacaagcgggagcugcccaaacgccacauccaaaagcggauucuucgccacaauggcaugggcgguaccaaaagacaacaauaaaaacgcaacaaacccccucacagucgaaguaccauacauaugcgcggaaggagaagaccaaauaaccguauggggcuuccacagugacaacaaaacccagaugaagaaccuauauggggacucaaacccccaaaaauucaccaguucagcaaauggggugacuacccacuacgucucgcaaauaggaggcuucccggaccagcgcgaagacggcggacugccccaauccggccgcauaguaguagacuauaugaugcaaaaacccggaaagacaggcacgauaguguaccaacguggaguacugcucccgcaaaaaguauggugcgcaagcggacgaucgaaggucaucaagggcucacucccgcucauaggagaggccgacugucugcacgagaaauacggcgggcucaacaaaagcaaacccuauuacaccggcgaacacgccaaggccauaggaaacugccccaucugggucaaaaccccacucaaacucgcaaacggaaccaaauaccgaccuccagcaaagcuccucaaagagcgaggcuucuucggagccauagcaggauuccucgaaggcggaugggaaggaaugauagcuggcuggcacggauacacaucccacggagcccacggggucgccgucgccgccgaucuaaaauccacacaggaggcaauaaacaagaucacgaaaaaucucaacagucucagcgaacucgaagucaaaaaccuccaaagacuaucaggugccauggacgaacuacacaacgaaauccucgaacuagaugaaaaagucgacgaccuacgcgccgauacaauaucaagccaaaucgaacucgcaguacuccuaucaaacgagggcauaaucaacuccgaagacgaacaccuccucgcacuagaacgcaaacuaaagaaaaugcucggacccagcgccguagacaucggaaacggcugcuucgaaacaaagcacaaauguaaccaaacaugccucgaccgaaucgccgccggcaccuucaaugcaggcgaguucucccuuccaacauucgacucacucaacaucacagcagcaagccuaaacgacgacggacucgacaaccacaccauacuccuauacuacagcacggccgcgagcucccucgccgucacccuaaugcuggcaaucuucaucguauauauggucagccgcgacaacguaagcugcuccauuugccuauga

SEQ ID NO: 215874 - RNA, 1755 nt, Artificial Sequence
  derived and/or modified sequence opt from Influenza B hemagglutinin
augaaagccgugauaguacuacuaauggucguaacaagcaacgccgacaggaucugcacgggcauuaccucaagcaacucaccacacguaguaaaaaccgccacacaaggagaagugaacgucacaggcgucaucccccuaaccacgaccccaacaaaaucguacuucgcaaaccuaaaaggaacacguacccgcggaaaacugugcccagacugccuaaacuguaccgaccuagacgucgcccucggccggcccaugugcguaggcacuacccccagcgcaaaagcgagcauacuacacgaagugcgcccugucacguccggcugcuuccccaucaugcacgacagaacaaaaaucagacaacuaccaaaccuacuccgcggauacgagaaaauccgccucuccacccaaaacgucauagacgccgaaaaagcccccggcggacccuaccgccuaggcacaucaggauccugcccaaacgcaacaagcaaaaucggauucuucgccacgauggccugggccguucccaaagacaacuacaaaaacgcuaccaacccucucacaguggaagucccauacauaugcacagaaggcgaagaccaaaucaccgucuggggauuccacagcgacaacaaaacccaaaugaagucacucuacggggacuccaacccccaaaaauucaccuccuccgccaacggagugaccacccacuacgucucgcaaaucggcgacuuccccgaccaaaccgaagacggcggacugccacagagcggacgcaucguaguggacuacaugaugcaaaaaccuggaaaaaccggcacaauagucuaccaacgaggcguccuacuaccacaaaaagucuggugcgcauccgggcgcucaaaagucaucaaagggagccucccacuaauaggcgaagccgacugccuccacgaagaauacggagggcucaacaaauccaaaccguacuacacaggcaaacacgccaaggccauaggcaacugcccgaucugggucaaaacaccccuaaaacuugccaacggaaccaaauacaggccacccgcaaaacuccuuaaagaaagaggauucuuuggugccaucgcagguuucuuagaaggaggcugggaaggcaugaucgcaggcuggcacggcuacaccagccacggagcacacggcgucgcggucgcagccgaccucaaaagcacacaagaagccauaaacaaaauaaccaaaaaccuuaacuccuuauccgaacuagaagucaaaaaccuacaacgacugucgggcgccauggacgaacuccauaacgaaauacucgaacucgacgaaaagguagacgaccuaagagccgacaccauauccagccaaaucgaacucgccguucuacucucaaacgagggaaucaucaauagcgaagacgagcaccuacucgcgcucgaaagaaaacucaagaaaaugcucggccccucagccguagacauaggcaacggcugcuucgaaaccaaacacaaaugcaaccaaacaugccucgacaggaucgccgccggaaccuucaacgccggcgaguucucgcucccaaccuucgacucacucaacauaaccgccgcaucauuaaacgacgacggacucgauaaccacaccauccuccuauacuacaguacagccgcaucuuccuuagccguuacccuuaugcuagccaucuucaucgucuacauggucucgcgcgacaacgucagcugcaguauaugucuguag

SEQ ID NO: 215875 - RNA, 1758 nt, Artificial Sequence
  derived and/or modified sequence opt from Influenza B hemagglutinin
augaaagccaucauaguccugcucauggucguaaccuccaacgccgaccgaauuugcacaggaaucaccagcuccaacagcccccacgucgucaagacagcaacccaaggggaaguaaacgucacaggcgucaucccccucaccaccaccccaaccaaaucccacuucgccaaccuaaaaggaaccgaaacacguggcaagcucugcccuaaaugccucaacugcaccgaccuagacgucgcacuugggcguccaaaauguacgggaaagauacccuccgcccgggucuccauccuucacgaaguacgacccgucaccuccggaugcuucccuauaaugcacgaccgcaccaaaauacgccagcuccccaaccucuuacgaggcuacgaacacaucagacuaucaacccacaacguaaucaacgccgaagacgcacccggcggcccauauaagauugggacauccggcuccugcccaaacguaacaaacggcaacggauucuucgccacaauggccugggccguccccaaaaacgacaaaaacaaaacagccacaaacccccuaaccaucgaagucccauacauaugcaccgaaggagaagaccaaaucaccguauggggguuccacagcgacaacgaaacccaaauggcgaaacucuacggcgacucaaaaccccaaaaauucaccucuucagccaacggagucacaacccacuacgucucccaaaucggcgguuuucccaaccaaaccgaagacggcggccugccacaauccgggcgcaucgucgucgacuacaugguacagaaaucagguaaaaccggaacaaucacauaccagcgcggaauccuccucccacaaaaagucuggugcgccuccgggcggucuaaaguaauaaagggcucgcucccgcuaaucggagaagcagacugccuucaugaaaaauacggcggccucaacaaaucaaaacccuauuauaccggcgaacaugccaaagccauuggcaacugccccaucuggguaaaaaccccacucaaacuggccaacggcaccaaauacagaccacccgccaaacuccucaaagaacgaggcuucuucggcgccaucgcuggauuccucgaagguggcugggaaggcaugaucgccggcuggcacggguacaccucacacggagcccacggagucgccgucgccgccgaccucaaguccacccaagaagccauaaacaaaauaaccaaaaaccuaaacagccucagugaacucgaagucaaaaaccuccaacgcuuauccggugcaauggacgagcuccacaacgaaauacucgaacuagacgaaaaaguagacgaccuccgagcagacaccaucagcucccaaaucgagcuugccguccuccuauccaacgagggcauaaucaauuccgaagacgaacaccuccuagcacucgaacgcaaacucaagaaaaugcucggucccuccgccguagaaaucggcaacggcugcuuugaaacaaaacacaaaugcaaccaaaccugccuagaccgaaucgccgcuggcaccuucgacgcaggcgaguucucgcuccccacauucgacucucuaaacaucacagcugccagccucaacgaugacggccucgacaaccacaccauccuccuauauuacucuaccgcagccagcuccuuagcaguaacgcuaaugauagccaucuucgucgucuacaugguaucacgcgacaacgugagcuguucaauaugccucuga

SEQ ID NO: 215876 - RNA, 1758 nt, Artificial Sequence
  derived and/or modified sequence opt from Influenza B hemagglutinin
augaaagccauaauaguccuccucaugguaguaaccuccaaugcagaccgaaucugcaccggaauaaccagcucaaacucgccccacgucgucaaaaccgccacacaaggagaagucaacguaacaggcgucauaccccucaccacgaccccaaccaaaucccacuucgccaaccucaaaggaaccgaaacaagaggcaaacuuugccccaaaugccucaacugcaccgaccucgacguagcccucggacgcccuaaaugcaccgguaaaauaccuucagcacgcgucucgauccuacacgaagucagaccaguaaccucaggcugcuuccccaucaugcacgaccgcaccaaaauacgacaacuacccaaccuacuacgcgguuacgaacacauacgucuaucgacccacaacgucauaaaugccgaagacgcccccggcggcccauacaaaaucggcacauccggauccugcccaaacgucacaaauggcaacgguuucuucgccaccauggccugggccguaccgaaaaacgacaaaaacaagacagccaccaauccacucacgauagaaguccccuacauaugcacagaaggagaagaccaaaucaccgucuggggauuccacagcgauaucgagacccaaauggccaaacuauacggggauuccaaaccgcaaaaguucacauccuccgcaaauggcgugaccacccacuacgucucccaaauaggcggcuuccccaaccaaaccgaagauggcggcuuaccacaguccggccguauaguagucgacuacaugguccaaaaguccggaaaaacggggaccaucacuuaccaacgcggcauccuauuaccacaaaaagucuggugcgccagcggacgauccaaaguaaucaagggcucccuaccccucaucggcgaggcagacugccuacacgaaaaauacggcggauugaacaaauccaaacccuacuacacuggagaacaugccaaagccaucggcaacugcccaaucugggucaagacgccgcuaaaacucgcgaacggaaccaaauaccgaccacccgcaaaacuccugaaagagcgcggauucuucggcgccauagccggcuucuuagagggcggcugggaaggcaugaucgccggcuggcacggcuacacaagccacggcgcacacggcgucgcagucgcagcagaucucaaauccacacaagaggccauaaacaaaauaaccaaaaaucucaacagccuaagcgaacucgaagucaaaaaccuccaacgccucuccggagccauggacgaacuacacaacgaaauacucgaacuagacgaaaaagucgacgaccuacgggcagacacaauaagcucccagauugaacucgcaguccuacuauccaacgagggaauaaucaacuccgaagacgaacaccuccucgcccuagaaagaaaacuaaagaaaaugcucggccccuccgccguagaaauuggaaacggaugcuucgaaacuaaacacaaaugcaaccaaacaugccucgaccggaucgcggccgggaccuucgacgcaggcgaguucucccucccaaccuucgacucccucaauauaacugcagcuagcuugaacgaugacgggcucgacaaccauaccauauuacucuacuacagcacagccgcauccucucucgccgucacccucaugaucgcuaucuucguaguauacaugguaucccgcgacaacguaagcugcuccaucugccuauag

SEQ ID NO: 215877 - RNA, 1758 nt, Artificial Sequence
  derived and/or modified sequence opt from Influenza B hemagglutinin
augaaagccaucaucgucuuguuaaugguagucaccuccaacgcagacagaauaugcaccggcaucacaucauccaacucaccacacgucgucaaaacagccacacaaggagaagucaacgucaccgggguaaucccccuaacgacgacaccaaccaaaagccacuucgcaaaccugaaaggaaccgagacccgaggaaaacuuugccccaaaugccucaacugcaccgaccucgacgucgcccucggacgccccaaauguaccggcaaaauaccuucggccagagucuccauccuacaugaaguccgcccagugaccucgggaugcuuccccaucaugcacgacagaacaaaaauccgacaacuaccgaaccuacuucgcggcuacgagcacaucaggcucucuacccacaacguaaucaacaccgaagacgcccccggcggcccguacaagaucggcaccucaggaucaugccccaacgugacaaacggcaacggcuucuucgcaaccauggccugggccgucccaaagaacgauaaaaauaaaacagccaccaacccccuaacaaucgaaguacccuacaucugcacagagggagaagaccaaaucacaguauggggcuuccacuccgacaucgagacacaaauggcuaaacucuacggugacucaaaaccacaaaaauucaccagcuccgccaacggcguaacuacccacuacgucucacaaaucggcggcuuccccaaccaaaccgaagacggagggcuuccccaaagcggccgcaucgucguagauuacauggugcaaaagucaggcaaaacagguaccaucacauaccagcgcggaauccuccucccgcaaaaggucuggugcgcaagcggacgcuccaaggucauuaaaggcucgcucccgcucauaggcgaagcagacugccuccacgaaaaauauggcggccucaacaaaucaaaacccuacuacacuggcgaacacgcaaaggccaucggcaacugccccaucuggguaaaaacaccccucaaauuagcgaacggcaccaaauaccgaccaccagccaaacuccuuaaagaacguggauucuucggcgccauugccggcuuccucgaaggcggcugggaaggcaugaucgccggcuggcacggcuacaccagccacggagcccacggagucgcagucgccgccgaccucaaauccacccaagaggccaucaacaaaauaacgaaaaaccucaacagccuaucagaacucgaggucaaaaaccuccaaaggcucucaggcgcgauggacgaacuccacaacgaaauccucgagcucgacgaaaagguagacgaccuccgcgcagacaccaucucaagccagaucgaacucgcaguacuccucuccaacgaaggcauaaucaacagcgaagacgaacaccuacuugcacucgagcgcaagcucaagaaaaugcucggccccucagccgucgaaaucggaaacgguugcuucgagaccaaacacaaaugcaaccaaaccugccucgaccgaaucgcagccggaacauucgacgcgggagaguucucucucccgaccuucgacucacuaaacaucacagcagcuucccuaaacgaugacggccuagacaaccacaccauacuccuguacuacuccaccgcagcgagcucccuagcaguaacgcucaugaucgccaucuucguagucuacauggucucccgcgacaacguaagcugcagcaucugccuuuaa

SEQ ID NO: 215878 - RNA, 1758 nt, Artificial Sequence
  derived and/or modified sequence opt from Influenza B hemagglutinin
augaaagccaucaucguccuccucauggucgugacauccaacgccgaccgaaucugcaccggcaucacauccucuaacucaccccacgucgucaagaccgccacgcaaggcgaagucaacguaaccgggguuauuccccucaccaccacccccaccaagagccacuucgcaaacuuaaaaggcaccgaaacccgaggaaaacucugccccaaaugccucaacugcaccgaccucgacgucgcccucggacguccaaagugcaccggcaaaauucccucagcccgagucuccauacuccacgaaguccgacccguaaccuccgguugcuuccccaucaugcacgaucgcacgaaaauacgccaacuucccaaccugcucaggggauacgaacacauacggcucuccacccauaacguaauaaacgccgaagacgcccccggcggacccuacaagauagggacauccggcucgugccccaacgucaccaacgguaacggcuucuucgccaccauggcaugggccguccccaaaaacgacaaaaacaagacagcaacgaacccacuaaccaucgaaguccccuacaucugcacagaaggcgaagaccaaauaaccguauggggauuccacagcgacaacgagauacaaauggcaaaacuauacggagauagcaaaccgcaaaaauucaccuccucggccaacggaguaaccacucacuacgucagccaaauaggcggcuuccccaaccaaaccgaagacggaggccuaccacaaagcggacgaauagucgucgacuacauggugcagaaaagcgguaaaaccggaaccauuaccuaccaacgcggcauccuccucccacaaaaagucuggugcgccagcgggcgauccaaagugauuaagggcucucuaccccuaauaggcgaggcagacugccuacacgaaaaauacggcggccuaaauaagucgaaaccguacuacaccggggaacaugccaaagcaauaggaaacugcccgaucugggucaagacaccgcuaaagcucgcaaauggcaccaaguacagaccacccgccaaguuacucaaagagcgcggcuucuucggagcgaucgcaggcuuccucgaaggcggcugggaaggcaugauagccggcuggcacggauacaccucccauggcgcacacggaguagcaguagcggcagaccucaaaucaacgcaagaagcaaucaacaaaauaacgaaaaaccucaacagcuuauccgagcucgaagucaaaaaccuacaacgacucucaggagcaauggacgaacuucacaacgaaauacucgaacuagaugagaaagucgacgaccuacgcgccgacacaaucuccagccaaauagaacucgcgguacuacucucgaaugaaggaauaaucaacuccgaggacgaacacuugcucgcccucgaacgcaaacucaagaaaaugcucggucccuccgccguagaaauuggcaacggcugcuucgaaaccaaacacaaaugcaaucaaaccugccuggauagaauugcagccgggaccuucgacgccggcgaguucucccuacccaccuuugacucgcucaacaucacagccgcuucccucaacgacgacgggcuugauaaucacaccauacuacuguacuacagcacagccgcauccucgcucgccgucacccucaugauagccaucuucgucguauacaugguuucccgcgacaacguaagcugcagcauaugccuauaa

SEQ ID NO: 215879 - RNA, 1755 nt, Artificial Sequence
  derived and/or modified sequence opt from Influenza B hemagglutinin
augaaggcaaucaucguacuccuaaugguagucacauccaacgccgaccgcauaugcaccggaauaaccucaagcaacucaccgcacguggucaaaacagccacacaaggcgaagucaacgucaccggcgucaucccgcucacaacaacaccaacaaaaucguauuucgcaaaccucaaaggcacacgcacacgcggcaaacucugccccgacugucucaacugcacagaccuugacguagcacuggguagacccaugugcguaggcacaacaccaagcgccaaagcgaguauacuacacgaaguacgaccagucacgagcggaugcuuccccauuaugcacgaccgaacaaagauccggcaacuaccaaaccucuuacgcggauacgagaaaauccgccuaagcacccaaaacguuauugacgcagaaaaagccccaggaggacccuaccgauuaggcacaagcggcuccugccccaacgccacgagcaaaaucggcuucuucgcaaccauggccugggccgucccaaaggacaauuacaaaaacgccacaaacccgcucaccgucgaaguuccauacaucugcacggaaggagaagaccaaauaacagucuggggauuccacagcgacaacaaaacacaaaugaagucacuguauggagacuccaacccacaaaaguucacgagcuccgcaaacggcgugaccacgcacuacguaucacaaauaggcgauuucccggaccaaaccgaggacggcggccuuccacaaagcgggagaauagucguggacuacaugaugcaaaaacccgggaaaacgggaacaauugucuaucagcgcggcguccuacuaccgcaaaaagucuggugcgccagcggccgcucuaaagugaucaaaggaucucucccacuaaucggagaagccgacugccuccacgaagaauacggcggacuaaacaaaucgaaacccuacuacacuggaaaacacgcuaaagccauaggcaacugcccaaucugggucaaaacaccccucaaacucgcaaacggaaccaaauaccggccaccggccaaacuccuaaaagagcgcgguuucuucggcgccaucgccggauuucuagagggaggaugggaaggcaugauagcaggcuggcacggcuacaccagccacggcgcccacggcguugccgucgccgccgaccuaaaaucaacccaagaagccauaaacaaaaucaccaaaaaccucaauucccugagcgaacucgaagucaaaaaucugcaacgacucucuggcgccauggacgaacuccacaacgaaaucuuagaacucgacgaaaaaguugaugaccugcgcgcggacacaauuuccucacagaucgaacucgccguccuucuaucaaacgaaggcauaauaaacagcgaagaugaacaucuccucgcacuggagcgcaaacuuaagaaaaugcucgggcccucagccguugacauaggcaacggcugcuucgagaccaaacacaaaugcaaccaaaccugccuggacagaaucgccgccggcacauuuaacgcgggcgaguucucccuccccaccuucgacucccucaacauaacugcggccucccuaaacgacgacggacuagacaaccacaccauacuccucuacuacucaacagcagccuccucacuagccgucacacucaugcucgcgauauucaucguauacaugguaagccgagacaacguaagcugcagcauaugccuguaa

SEQ ID NO: 215880 - RNA, 1755 nt, Artificial Sequence
  derived and/or modified sequence opt from Influenza B hemagglutinin
augaaagccaucaucgugcuacugaugguaguaaccaguaacgccgacagaaucugcacuggcauaaccuccuccaauaguccacacguagucaaaacagcaacacaaggggaagucaaugucacgggcgugaucccccucacgaccacccccacgaagucauacuucgccaaccuaaaaggaacacgaacacgagggaaacucugcccggacugccuaaauugcacggaccuagacguggcacucggccggcccaugugcgucggcacgaccccaagcgccaaagcaagcauacuucacgaaguacgccccgucaccagcggcugcuuccccauaaugcaugacagaacgaagauaagacaacuccccaaccuccuacgcggcuaugagaaaauacgucucagcacgcaaaaugucauagacgcagaaaaagcaccaggcgggccauaccgacuaggcacaagcggaagcugccccaacgccacaagcaaaaucggcuucuuugcaacuauggcaugggccgucccaaaagacaacuacaaaaacgccacaaacccacucacaguugaggucccauacauuugcacggaaggcgaagaccaaauuaccguguggggauuccacuccgacaagaaaacccaaaugaagucauuauacggagacagcaacccacaaaaauucacgagcuccgccaacggagugaccacgcacuacgucucacaaauaggcgauuucccagaccaaacagaagacggcggacugccacaaucaggccgcauaguaguagacuauaugaugcagaaaccagggaaaacaggcacaaucguuuaccaacgaggcguccuccucccacaaaaagucuggugcgcuuccgggcguucaaaagugaucaagggaagccucccacucauuggcgaggccgacugccuccacgaagaauacggcggacuaaacaaaucaaaaccuuacuacacagggaaacaugccaaggccauaggcaacugcccaaucugggucaagacaccgcucaaacuagcaaacggaaccaaguacagaccaccagccaaacuucugaaagaacgcggauucuucggagccaucgcuggcuuccucgaaggagggugggaaggcaugaucgcaggcuggcacgguuacacaagccacggcgcacacggggucgccguagcggcagaucucaaaagcacgcaagaggcaaucaacaagaucacgaaaaaccucaacagccuaagcgagcucgaagucaaaaaccuacaaagacucucgggcgcgauggacgaacuccauaacgaaauacucgaacucgacgaaaaaguagacgaccuacgcgcggacaccaucucaagccagaucgaacucgcgguccuccucucuaacgaaggcauaaucaauagcgaagacgaacaucugcucgcgcucgaacgcaagcucaagaaaaugcucggccccuccgcuguggacauaggcaacggcugcuucgaaaccaaacacaaaugcaaccaaacgugccucgaccggaucgcagccggaaccuucaacgcaggcgaauuuucgcuaccgaccuucgacucgcucaacaucacagccgcaucccuaaacgacgacgggcucgauaaccacacaauccuccuuuacuacucaacggcagcgucaucgcucgccgucacacuaaugcucgcgaucuucaucguguacauggucucacgcgauaacgugaguuguagcaucugucuguga

SEQ ID NO: 215881 - RNA, 1755 nt, Artificial Sequence
  derived and/or modified sequence opt from Influenza B hemagglutinin
augaaagccauaauaguacuacuuauggucgucacgagcaacgcagaucgcauauguacgggcauaaccuccucuaauagcccccaugucgucaaaaccgcgacacaaggcgaggugaacgucacaggaguaauaccccuaaccaccacacccaccaaaucguacuuugccaaccucaaaggcacacgaacacgaggaaaacucugccccgacugucuaaacugcacagaccuggacguagcccuagguaggccaaugugcguaggaacaaccccgagcgccaaagccagcauacuccaugaaguccgcccagucacaagcggcugcuucccaauaaugcacgaccgaaccaagaucaggcaacuacccaaucuccuccgagguuacgagaaaauacgccuauccacccaaaaugucaucgacgcggaaaaagccccaggcgggcccuaccgacuaggcacguccggaaguugccccaaugccaccagcaaaauaggauucuucgccacuauggcaugggccguccccaaagacaacuacaaaaacgcaacuaacccacucaccgucgaagucccauacauaugcaccgaaggcgaagaccaaaucacagucuggggguuccauagcgacauaaaaacccaaaugaaguccuuguacggagacagcaacccacaaaaauuuaccucaucagccaacggaguaaccacccacuacgucucgcaaauaggcgauuuccccgaccaaaccgaagacggaggccugccccaauccgggcgcauagucguagacuacaugaugcaaaaacccggaaaaaccggaaccaucguauaccaacgagggguccuacucccacaaaaaguauggugcgcauccggacgcuccaaaguaauaaagggcucacuaccacucaucggcgaagcagacugccugcacgaggaguauggcgggcucaacaaaucgaaacccuacuauaccggcaaacacgcaaaagccauaggcaacugccccaucuggguuaaaacaccucucaaacuugcaaacgggacaaaauacaggccaccagcuaagcuccucaaagaacgcggcuucuucggcgcgaucgcaggcuuccucgagggagggugggaaggcaugaucgccggcuggcacggguacacaagccacggcgcgcacggaguagcugucgcggccgaccucaaguccacucaagaagccauaaacaagaucaccaaaaaccucaacucccuuagcgaacucgaagucaaaaaccugcaaagacuuuccggcgccauggacgaacuucacaacgaaauccuagaacucgacgaaaaaguagaugaccuacgcgcagacacgaucagcucccaaaucgaacuagccguccuacucucgaacgagggaaucaucaacagcgaggacgaacaccuucuagcacucgagcgaaaacuuaagaaaauguuaggacccucggcugucgacauaggcaauggcugcuucgagaccaaacacaaaugcaaccaaaccugccuagaccgcaucgcagcuggcacauucaacgccggcgaguuuucacuccccacauucgacucccucaacauuacggccgcaucacucaacgacgacggacucgauaaccacaccauacuacuuuacuacagcacggccgcguccucacucgcaguaacacucaugcucgcaaucuucaucguguacaugguauccagagacaacgucagcugcagcauaugccuauaa

SEQ ID NO: 215882 - RNA, 1755 nt, Artificial Sequence
  derived and/or modified sequence opt from Influenza B hemagglutinin
augaaggccauaaucguccuccucauggucgucaccagcaacgccgaccgcaucugcaccggcauaacaagcaguaauuccccgcacgucguaaagacagcgacacaaggcgaagucaacguaacaggcgucaucccucucacaaccacccccaccaaaagcuacuucgcaaaccuaaaaggaacccgcacgcgcggcaaacucugccccgauugccucaacugcaccgaccucgacguugcccucggaagacccaugugugucggcaccacccccuccgcaaaagccagcauccuccacgaaguccggcccaucacaagcggaugcuuccccaucaugcacgaccggacaaagauccgacaacuccccaaucuucuaagaggcuacgagaaaauacgacucuccacccaaaacgucauugacgccgaaaaagccccaggcgggcccuaccgccugggaacauccggauccugccccaacgccacaucaaaaaucgguuucuucgccacaauggcgugggcaguaccaaaagacaacuauaaaaacgccacaaacccccuaacagucgaaguccccuacauaugcacagaaggcgaagaccaaauaaccgucuggggauuccacagcgacgaaaagacccaaaugaaaucccucuacggugacucuaacccucaaaaauucaccuccucugcaaacggagucacaacacacuacgucucccaaauaggagacuucccagaccagaccgaagacggaggccucccccaauccggacgcaucguagucgacuacaugaugcaaaaacccggcaaaacaggaacgauagucuaccaacgcggcguccuacuaccccaaaaagucuggugcgccuccggccgaucgaaagucauaaaaggaucucucccccucauaggcgaagccgacugccuacacgaggaauacggcggacucaacaaaucaaaacccuauuacacaggaaaacacgccaaagccaucggaaacugcccaaucugggucaaaacaccccucaaacucgcaaacggcacaaaguaccgcccacccgcaaaacuccucaaagaacgcggauucuucggcgccaucgccggcuuccuagagggcggaugggagggcaugaucgccggcuggcacggauacaccucacacggagcgcacggugucgcagucgccgcggaccucaaaucuacacaagaagccauaaacaaaaucaccaaaaaccuaaacucccucucagaacucgaagucaaaaaccuccaaaggcucuccggugcgauggacgaacuccacaacgaaauccucgaacuagacgaaaaaguagacgaccucagagcagacacaaucuccucccaaaucgaacucgccguacuccucuccaacgaggguauaaucaacuccgaggacgaacaccuccucgcccuagaacgaaaacucaagaaaaugcucgggcccagugccgucgauaucgguaacggcugcuucgaaacuaaacacaaaugcaaccaaaccugccucgaccgcauugccgccggcaccuuuaacgccggcgaguucucccucccaacauucgacucacucaacaucacagcagccagccucaacgacgacggacucgacaaccacaccauacucuuguauuacaguaccgccgccucaucacucgcgguaacccuaaugcucgccaucuucauaguauacaugguaucccgcgacaacgucagcugcagcaucugcuuauga

SEQ ID NO: 215883 - RNA, 891 nt, Artificial Sequence
  derived and/or modified sequence opt from Influenza B hemagglutinin
augaaagccaucauagugcuacuuauggucguaaccagcaacgccgaccgcaucugcacaggcaucaccuccagcaacucuccccacguugucaaaacagccacccaaggcgaagucaacguaacaggcgucaucccgcucaccaccacacccacaaaaucauacuucgcaaaccucaaaggcacccgcacucgcggcaaacugugcccagacugccucaacugcacagaccuggacguagccuuaggacgccccaugugugucggcaccacccccagcgcaaaagccagcauccugcacgaaguccgcccgguaacaagcgguugcuucccaauaaugcacgacagaacaaagauacgccaacuacccaaccuacuccgaggguacgaaaagauccgccuaagcacccaaaacguuauagacgcugaaaaagcccccggcggacccuaccgacucggaaccagcggcucuugcccaaacgccaccucaaaaaucggauucuucgccacaauggccugggcuguccccaaagauaacuacaaaaacgccacuaacccacucaccgucgaaguccccuacauaugcacagaaggagaagaccaaaucacagucuggggcuuccacuccgacgagaaaacucagaugaaaagccucuacggagacucaaacccccaaaaauuuacgagcuccgccaacggcgucacaacgcacuacgucucccaaauuggcgacuuccccgaccaaaccgaggacggaggacuaccacaaagcggaagaauagugguagacuacaugaugcaaaaacccggcaaaaccggcacaaucgucuaucaacgcggcguacuccucccccagaaagucuggugcgcauccggccgcucaaaagucauc

SEQ ID NO: 215884 - RNA, 1758 nt, Artificial Sequence
  derived and/or modified sequence opt from Influenza B hemagglutinin
augaaagcgaucaucguccuacucaugguagucacaucaaacgccgaccgaaucugcacaggcauaaccagcagcaacaguccccacgucgucaagaccgccacucaaggcgaaguaaauguaaccggagucaucccccucaccaccaccccgaccaagucccauuucgcuaaccucaagggcaccaaaacacgaggcaaacuaugccccaaaugccugaacugcaccgaccucgacguagcccuagcccgcccaaaaugcaugggcaccaucccauccgccaaagccuccauacuccacgaaguaaaaccagugacauccggcugcuucccgaucaugcacgaccgcacuaaaauccgccaacuucccaaccuacucagaggcuacgaacauauccgccucuccacccacaacgucauaaacgcugaaaccgcccccggcggacccuacaaaguagggacaucaggaucaugccccaacgucaccaacggcaacggcuucuucgccaccauggcaugggcuguacccaaaaacgacaacaacaaaaccgcgaccaacccccucaccgucgaaguccccuacaucugcaccgaaggugaggaccaaaucaccgucugggguuuucacagcgacagcgaaacccaaaugguaaaacuauauggcgacuccaaaccacaaaaauucacauccuccgccaacggcgugacaacccacuacguaucccaaauaggcggcuuccccaaccaagccgaagacgguggcuuaccucaaagcggacgaaucgucguagauuacaugguacaaaaaucagggaaaaccggcaccaucacuuaccaacgcggcauccuccucccccaaaaaguauggugcgccagcggaagaucaaaagucaucaaaggcucgcuuccccuuaucggagaagccgacugccuacacgaaaaauacggcggccucaacaaauccaaacccuacuacaccggagaacacgccaaggccaucggcaauugcccaauaugggucaaaacccccuugaaacucgcaaauggcaccaaauaccgcccucccgcaaaacuccugaaagagcgaggcuucuucggugcaaucgccggauuccuagaaggcggaugggaagggaugaucgccggcuggcacggauacaccagccacggagcccacggcgucgcagucgcagccgaccucaaaucaacacaagaggccauaaacaaaauaacgaaaaaccucaacuccuuaagcgagcucgaagucaaaaaccuccaacgacucaguggcgccauggacgaacugcacaacgaaauccuagaacucgacgaaaagguagacgaccuacgugccgacacaaucuccagccaaaucgaacucgcaguucuccugucaaacgaaggaaucauaaacagugaagacgaacaccuccucgcccuagaacguaagcuaaagaaaaugcucggccccucagccgucgaaaucggcaacggcuguuucgagaccaaacacaaaugcaaccaaacaugucucgaccgcaucgccgcagguaccuucaacgccggcgaguucucacuuccaaccuucgacucccuaaacauuacagccgccagccugaacgacgacggccuagacaaccacacaauccuacuguacuacagcacggcagccuccucacucgcagucacgcuaaugaucgcaaucuucaucgucuacaugguaucucgcgacaacguuagcugcagcaucugccucuag

SEQ ID NO: 215885 - RNA, 1755 nt, Artificial Sequence
  derived and/or modified sequence opt from Influenza B hemagglutinin
augaaagccaucaucguccuccugaugguagugaccaguaacgcugaccgcauaugcacuggaauaaccucuagcaacuccccacacguagucaagaccgcaacccagggcgaagucaacgucacaggcguaaucccgcuuacaaccacgccaaccaaaucauacuuugcaaacuuaaaaggcacacgcacaagagggaaacucugcccugacugccucaacugcacggaccuagacguagcccugggcagacccaugugcgucggaacaacaccaucagccaaagccuccauccuccacgaaguacgacccguaacaagcgguugcuuccccauaaugcacgaucgcaccaagauccgacaacugcccaaccuccugagaggauacgagaacauccgccucucaacacaaaacgucaucgacgcagaaaaagcaccuggaggacccuaccgauuaggcacaagcgggagcugccccaacgccacaagcaaaauaggcuucuucgcuacaauggcaugggcagucccaaaagacaacuacaaaaacgccacaaauccacuaaccgucgagguaccguauauaugcacagaaggggaagaccaaaucaccgucuggggcuuccacuccgacaacaaaacccaaaugaaaagccuauacggagacucaaacccccaaaaauucaccagcucggccaacggcguaaccacgcauuacgucucacaaaucggcgacuucccagaccagaccgaagacggaggccucccucagagcgggcgaaucgucguagacuacaugaugcaaaaacccgggaaaaccgguacgaucgucuaccagcgcggcguccuacuaccgcaaaaagucuggugcgcgagcggcagaagcaaaguaaucaaaggaucacuaccccuuauaggugaagccgauugccugcacgagaaauacggcggacuaaacaaauccaaacccuacuacaccggcgaacacgccaaggccauaggcaacugccccaucuggguaaaaaccccgcucaagcucgccaacggaaccaaguaccgaccaccagccaaacuacucaaagagcgaggguucuuuggcgcaaucgccggcuuucucgaagggggcugggaggggaugaucgcaggcuggcacggcuacaccagccacggcgcccacggaguagcagucgcggccgaccuaaagagcacacaagaagccaucaacaagaucaccaaaaaccucaacaguuugagcgaacucgaggucaaaaaccuacaaaggcucagcggugcaauggacgaacuccacaacgaaauacucgagcuagacgaaaaaguagacgaccuccgcgccgacacaaucuccucccaaaucgagcucgccguucugcucucaaacgaaggcaucaucaacucagaggacgagcaccuacucgcacucgaacgcaaacucaagaaaaugcucggacccucagccguagacauuggcaacggauguuucgaaaccaaacacaaaugcaaucaaacgugucuugaccgaaucgcggccggaaccuucaacgcaggagaguucucacucccgacauucgacucccuuaacaucacagccgccuccuuaaacgacgacggccuagacaaccacaccauccuccucuacuacagcaccgccgcaagcucacucgccgucacacuaaugcucgccaucuucaucgucuacaugguaucucgugacaacguaucuugcuccauuugccuauaa

SEQ ID NO: 215886 - RNA, 1755 nt, Artificial Sequence
  derived and/or modified sequence opt from Influenza B hemagglutinin
augaaagcaauaaucguacuccugauggugguaacauccaaugccgaccgaaucugcaccggcauaaccucauccaacagcccccacgucgucaagaccgccacucagggcgaaguaaacgucacaggcgucauaccacucacgaccacuccaacaaagucguacuucgcaaaccuaaaaggcacgcgaacacgcggaaaacuaugcccagacugccucaacugcacagaccuggacguagcccucggaaggcccaugugcgucggcacaacccccagcgcgaaagcguccauacuccacgaaguaagacccguaacuagcggaugcuuccccauuaugcaugacagaaccaaaauccggcaacuccccaaccuccuacgcggauaugaaaacauacgccuaagcacacaaaacgucauugacgcagaaaaagcuccuggaggccccuaucgccugggcacauccgggagcugccccaacgccacauccaaaaucggguucuucgcuacaauggcaugggcggucccaaaagacaacuacaaaaacgcaacaaacccgcuaaccgucgaagucccauacaucugcacagaaggggaggaccaaauaaccguauggggcuuccacagcgacaacaaaauacaaaugaaaagucuguacggugacucgaacccgcaaaaauucaccucuucggccaacggagucacuacacacuacguaucacaaaucggcgacuuccccgaccagaccgaggacggaggccucccacaaagcggacgaauaguaguugacuacaugaugcaaaagcccgggaaaacaggcacaaucgucuaccagcgcggaguacuacucccacaaaaaguauggugcgcuuccggacgcucaaaagucaucaagggaucacuaccgcuaauaggagaggccgauugccuccacgaaaaguauggcggccucaacaaguccaaaccauacuauaccggagaacacgccaaagccauaggaaacugcccaaucugggucaaaacaccccuaaagcucgcgaauggcacaaaguaccggccaccagcaaaacuccucaaagagcgcggauucuucggcgcuaucgccggcuuucuagagggcggcugggaaggcaugauagcggguuggcacggguacaccucccacggcgcgcacggcguugcagucgcagccgaccuaaaaagcacacaagaagcgauaaacaagaucaccaaaaaccucaacagcuuguccgaacucgaagucaaaaaccuacaaagacucuccggcgcuauggaugaacuacacaacgaaauccucgagcucgacgaaaaagucgacgaccuccgcgcggacacaaucucaagccaaauagaacuagcaguccugcugucgaacgagggcaucaucaacagcgaagacgaacaccuccucgcccucgaacgcaaacuaaagaaaaugcucggccccucagcaguagacaucggaaacggcugcuucgagaccaaacacaaaugcaaccaaacaugucucgacaggaucgccgcgggaaccuucaacgccggcgaguucucgcucccaaccuucgacucccucaacaucacagccgcaagccugaacgacgacggcuuagacaaccacacaauccuacuguacuacagcacagccgcgagcucacucgccguaacguuaaugcucgccaucuucauagucuacaugguaucacgagacaacguaagcugcagcauaugccuguaa

SEQ ID NO: 215887 - RNA, 1755 nt, Artificial Sequence
  derived and/or modified sequence opt from Influenza B hemagglutinin
augaaagccauaaucguccuacucauggucguuacaagcaacgcagaccgaauaugcaccggaaucaccucaagcaacucgccccacgucgucaaaacagcaacccaaggcgaaguaaacguaaccggcguaauaccacucaccaccacacccaccaaauccuacuucgccaaccuaaagggcacacgcacacgagggaaacugugcccagacugccucaacugcacagaccucgacgucgcccucggcaggccaaugugcguaggcacaacccccagugcgaaagcaagcauccuccacgaaguccgacccgucacaagcggaugcuuucccaucaugcacgacagaacuaaaaucagacagcuacccaaccuccuacgcggauacgagaacauacgcuuaucaacacaaaaugucaucgacgccgaaaaagccccaggcggcccauaucgauugggaaccagcggaaguugcccaaacgcaacgagcaagaucggcuucuucgccacgauggcgugggccguaccaaaagauaacuacaagaacgccaccaacccgcucaccgucgaagucccauacauaugcaccgaaggggaagaccaaauaacaguauggggcuuccacuccgacgacaaaacacaaaugaaaucccucuacggagacucaaacccacaaaaauucacauccucagcaaacggcguaaccacgcacuacgucucgcaaauaggcgauuucccugaucaaacagaagacggcggcuuaccacagagcggacgaauaguaguugacuauaugaugcaaaaaccagggaaaacgggcaccaucguguaccagcgcggaguacuacucccccaaaaagucuggugcgcgagcggccgcucgaaagucaucaagggaucgcucccccuaaucggagaagccgauugccuacacgaaaaauacggaggacucaacaaaucgaaacccuacuacaccggcgaacacgccaaagcaauaggcaacugcccgaucuggguaaaaacaccacucaaacucgcaaacggcacaaaauaccgacccccagccaagcuccucaaagagcgcggguucuucggagcaauagccggauuucucgagggcggcugggaaggaaugaucgcaggauggcacggguacacuagccacggcgcccacggaguagccgucgccgcugaccucaaaucaacccaagaggccauaaacaaaauuacgaaaaaccucaacagccuaagugagcucgaagucaagaaccugcaacgccucuccggagcaauggacgaacugcacaacgaaauccuagaacucgaugaaaaagucgacgaccugcgcgcagacaccauauccagccaaaucgaacuagccguccuacuaucaaaugaaggcauuaucaacagcgaagacgagcaccuccuggcgcucgaacgcaaacucaagaaaaugcucggucccucagccguagacauaggcaacggaugcuucgaaaccaaacacaaaugcaaccagacaugccuggacaggaucgccgcagggacauucaacgccggcgaguucucgcuccccacauucgacucgcucaacaucaccgcagcaucccuaaaugacgacggacuagacaaccacaccauccuccuguacuacagcacagcagcaucaucccucgcgguaacgcucaugcuagcgaucuucauugucuacauggucuccagagauaacgucucaugcagcauaugccuauaa

SEQ ID NO: 215888 - RNA, 1752 nt, Artificial Sequence
  derived and/or modified sequence opt from Influenza B hemagglutinin
augaaagcaauaaucguccugcuaauggucgucaccuccaacgccgaccgcauuugcaccggcauaacauccucaaauucaccacacguagucaaaacagccacacaaggagaaguaaacgucaccggcgucaucccucuaaccaccaccccaacaaaaagccacuucgccaaccuaaaaggcaccaaaacaagagguaaacucugccccaacugccuaaacugcaccgaccucgacguagcacucggccgaccuaugugcauggggaccauacccucagccaaagccucuauccuccacgaaguccgcccagucaccuccggaugcuucccaaucaugcaugaccgcacuaaaauccgccaacuaccuaacuuacucagaggcuaugaaaacaucagacucucgacucacaacgugaucaacgccgaacgagccccagggggaccguaccgccuagguaccuccggcagcugccccaacgucaccucgcgaaacggcuucuucgccacuauggcaugggcuguccccagagacaacaaaacagccacaaauccgcucacagucgaaguacccuacaucugcacgaaaggagaagaccaaauaaccguguggggcuuccauuccgacgacaaaacacaaaugaaaaaccucuacggagacuccaacccgcaaaaauucaccagcuccgccaacggcgucaccacccacuacgucucacaaaucggcgacuucccgaaccaaacagaagacggaggccucccacaauccgggcgcauaguaguagacuacaugguacaaaaaccaggaaaaaccggaaccauaguuuaccagcgcggaguucuucucccccaaaaagucuggugcgccuccgggcgcucaaaagucaucaaaggcucccucccgcucaucggcgaagccgacugccuccacgaaaaauacggaggacuaaacaaaagcaaacccuacuacaccggcgaacacgccaaagcaaucggaaauugcccaaucugggucaaaacaccgcucaagcucgccaacggcaccaaguacagacccccagccaaacuacugaaagaacgcggauucuucggcgcgaucgccggcuuccucgaaggcggcugggaagguaugaucgcaggcuggcacggauacaccagccacggcgcacacggugucgcagucgcggccgaucucaagagcacccaggaagccaucaacaagauaaccaaaaaccucaacucccuauccgagcucgaagugaaaaaccuacaacggcucucgggcgcuauggacgaacuacacaacgaaauccuagagcucgacgaaaaaguagacgaccuacgagcagacacaaucucaagccaaaucgagcuagccguccuacucucuaacgaaggcauaaucaacuccgaagacgaacaccuccucgcccuagaacggaaacucaagaaaaugcuaggccccucagccguagauaucggcaauggcugcuucgaaacaaaacacaaaugcaaucaaacaugccuagacaggauagcagcugggaccuucaaugccggagaguucucacucccuacuuucgacucucuuaacauaaccgcagcgucacucaacgacgacgggcucgacaaccacaccauccuccuguacuacagcaccgcagcaagcucgcucgccguaacccuaaugaucgcaaucuucaucguuuacaugguaucacgagacaacgucagcugcuccaucugccuguaa

SEQ ID NO: 215889 - RNA, 1758 nt, Artificial Sequence
  derived and/or modified sequence opt from Influenza B hemagglutinin
augaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagucccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcacgaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaaguccaagcccuacuacaccggggagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccucaagagcacccaggaggccaucaacaagaucacgaagaaccucaacucccugagcgagcuggaggugaagaaccuccagcggcuguccggcgccauggacgagcuccacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagacgugccuggaccgcaucgccgccgggaccuucgacgcgggcgaguucucccuccccacguucgacagccugaacaucaccgccgccucccugaacgacgacgggcucgacaaccacaccauccuccuguacuacagcaccgccgccuccagccuggcggucacgcucaugaucgccaucuucgugguguacauggucucccgggacaacgugagcugcuccaucugccuguga

SEQ ID NO: 215890 - RNA, 1975 nt, Artificial Sequence
  derived and/or modified sequence opt from Influenza B hemagglutinin
gggagaaagcuuaccaugaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagucccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcacgaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaaguccaagcccuacuacaccggggagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccucaagagcacccaggaggccaucaacaagaucacgaagaaccucaacucccugagcgagcuggaggugaagaaccuccagcggcuguccggcgccauggacgagcuccacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagacgugccuggaccgcaucgccgccgggaccuucgacgcgggcgaguucucccuccccacguucgacagccugaacaucaccgccgccucccugaacgacgacgggcucgacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215891 - RNA, 2140 nt, Artificial Sequence
  derived and/or modified sequence opt from Influenza B hemagglutinin
ggggcgcugccuacggagguggcagccaucuccuucucggcaucaagcuuaccaugaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagucccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcacgaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaaguccaagcccuacuacaccggggagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccucaagagcacccaggaggccaucaacaagaucacgaagaaccucaacucccugagcgagcuggaggugaagaaccuccagcggcuguccggcgccauggacgagcuccacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagacgugccuggaccgcaucgccgccgggaccuucgacgcgggcgaguucucccuccccacguucgacagccugaacaucaccgccgccucccugaacgacgacgggcucgacaaccacaccauccuccuguacuacagcaccgccgccuccagccuggcggucacgcucaugaucgccaucuucgugguguacauggucucccgggacaacgugagcugcuccaucugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215892 - RNA, 1755 nt, Artificial Sequence
  derived and/or modified sequence opt from Influenza B hemagglutinin
augaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccgcaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcacggagggcgaggaccagaucaccgucuggggguuccacagcgacaacaagacgcagaugaagucccuguacggcgacagcaacccccagaaguucacguccagcgccaacggggugaccacccacuacgugagccagaucggcgacuuccccgaccagaccgaggacggcgggcucccgcagagcggccgcaucgucguggacuacaugaugcagaagcccgggaagacgggcaccaucguguaccagcgcggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccucgagcuggacgagaaggucgacgaccuccgcgccgacacgaucuccagccagaucgagcuggcgguccugcucuccaacgagggcaucaucaacuccgaggacgagcaccuccuggcccucgagcggaagcugaagaagaugcugggccccuccgccguggacaucgggaacgggugcuucgagaccaagcacaagugcaaccagacgugccucgaccgcaucgccgcggggaccuucaacgccggcgaguucucccugcccaccuucgacucccugaacaucacggccgccucccugaacgacgacgggcucgacaaccacaccauccugcuguacuacuccaccgccgcgagcucccucgccgugacccugaugcuggccaucuucaucgucuacauggugagccgggacaacguguccugcagcaucugccucuga

SEQ ID NO: 215893 - RNA, 1972 nt, Artificial Sequence
  derived and/or modified sequence opt from Influenza B hemagglutinin
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccgcaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcacggagggcgaggaccagaucaccgucuggggguuccacagcgacaacaagacgcagaugaagucccuguacggcgacagcaacccccagaaguucacguccagcgccaacggggugaccacccacuacgugagccagaucggcgacuuccccgaccagaccgaggacggcgggcucccgcagagcggccgcaucgucguggacuacaugaugcagaagcccgggaagacgggcaccaucguguaccagcgcggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccucgagcuggacgagaaggucgacgaccuccgcgccgacacgaucuccagccagaucgagcuggcgguccugcucuccaacgagggcaucaucaacuccgaggacgagcaccuccuggcccucgagcggaagcugaagaagaugcugggccccuccgccguggacaucgggaacgggugcuucgagaccaagcacaagugcaaccagacgugccucgaccgcaucgccgcggggaccuucaacgccggcgaguucucccugcccaccuucgacucccugaacaucacggccgccucccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215894 - RNA, 2137 nt, Artificial Sequence
  derived and/or modified sequence opt from Influenza B hemagglutinin
ggggcgcugccuacggagguggcagccaucuccuucucggcaucaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccgcaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcacggagggcgaggaccagaucaccgucuggggguuccacagcgacaacaagacgcagaugaagucccuguacggcgacagcaacccccagaaguucacguccagcgccaacggggugaccacccacuacgugagccagaucggcgacuuccccgaccagaccgaggacggcgggcucccgcagagcggccgcaucgucguggacuacaugaugcagaagcccgggaagacgggcaccaucguguaccagcgcggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccucgagcuggacgagaaggucgacgaccuccgcgccgacacgaucuccagccagaucgagcuggcgguccugcucuccaacgagggcaucaucaacuccgaggacgagcaccuccuggcccucgagcggaagcugaagaagaugcugggccccuccgccguggacaucgggaacgggugcuucgagaccaagcacaagugcaaccagacgugccucgaccgcaucgccgcggggaccuucaacgccggcgaguucucccugcccaccuucgacucccugaacaucacggccgccucccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
